US012748103B2

(12) United States Patent
Milburn et al.

(10) Patent No.: US 12,748,103 B2
(45) Date of Patent: Sep. 29, 2026

(54) METHODS FOR SELECTING AND TREATING CANCER WITH FGFR3 INHIBITORS

(71) Applicants: GENECENTRIC THERAPEUTICS, INC., Durham, NC (US); THE UNIVERSITY OF NORTH CAROLINA AT CHAPEL HILL, Chapel Hill, NC (US)

(72) Inventors: Michael Milburn, Durham, NC (US); Gregory Mayhew, Durham, NC (US); Joel Eisner, Durham, NC (US); Charles Perou, Carrboro, NC (US)

(73) Assignees: GeneCentric Therapeutics, Inc., Durham, NC (US); The University of North Carolina at Chapel Hill, Chapel Hill, NC (US)

( * ) Notice: Subject to any disclaimer, the term of this patent is extended or adjusted under 35 U.S.C. 154(b) by 701 days.

(21) Appl. No.: 18/002,076

(22) PCT Filed: Jun. 22, 2021

(86) PCT No.: PCT/US2021/038446

§ 371 (c)(1),
(2) Date: Dec. 16, 2022

(87) PCT Pub. No.: WO2021/262696

PCT Pub. Date: Dec. 30, 2021

(65) Prior Publication Data

US 2023/0243813 A1 Aug. 3, 2023

Related U.S. Application Data

(60) Provisional application No. 63/042,309, filed on Jun. 22, 2020.

(51) Int. Cl.

*C12Q 1/6886* (2018.01)
*G01N 33/50* (2006.01)
*G16B 40/20* (2019.01)

(52) U.S. Cl.

CPC ....... *G01N 33/5091* (2013.01); *C12Q 1/6886* (2013.01); *G01N 33/5023* (2013.01); *G16B 40/20* (2019.02); *C12Q 2600/156* (2013.01); *C12Q 2600/158* (2013.01); *G01N 2333/71* (2013.01); *G01N 2800/52* (2013.01); *G01N 2800/7028* (2013.01)

(58) Field of Classification Search

None
See application file for complete search history.

(56) References Cited

U.S. PATENT DOCUMENTS 4,683,202 A 7/1987 Mullis
4,843,155 A 6/1989 Chomczynski
5,384,261 A 1/1995 Winkler et al.
5,445,934 A 8/1995 Fodor et al.
5,593,839 A 1/1997 Hubbell et al.
5,677,195 A 10/1997 Winkler et al.
5,708,153 A 1/1998 Dower et al.
5,733,729 A 3/1998 Lipshutz et al.
5,744,305 A 4/1998 Fodor et al.
5,770,358 A 6/1998 Dower et al.
5,770,722 A 6/1998 Lockhart et al.
5,789,162 A 8/1998 Dower et al.
5,795,716 A 8/1998 Chee
5,800,992 A 9/1998 Fodor et al.
5,854,033 A 12/1998 Lizardi
5,856,174 A 1/1999 Lipshutz et al.
5,874,219 A 2/1999 Rava et al.
5,922,591 A 7/1999 Anderson et al.
5,974,164 A 10/1999 Chee
6,020,135 A 2/2000 Levine et al.
6,033,860 A 3/2000 Lockhart et al.
6,040,138 A 3/2000 Lockhart et al.
6,040,193 A 3/2000 Winkler et al.
6,066,454 A 5/2000 Lipshutz et al.
6,090,555 A 7/2000 Fiekowsky et al.
6,185,561 B1 2/2001 Balaban et al.
6,188,783 B1 2/2001 Balaban et al.
6,223,127 B1 4/2001 Berno
6,229,911 B1 5/2001 Balaban et al.
6,308,170 B1 10/2001 Balaban
6,344,316 B1 2/2002 Lockhart et al.
6,420,108 B2 7/2002 Mack et al.
7,473,767 B2 1/2009 Dimitrov
8,492,094 B2 7/2013 Dimitrov et al.
2002/0183936 A1 12/2002 Kulp et al.
2003/0097222 A1 5/2003 Craford et al.
2003/0100995 A1 5/2003 Loraine et al.
2003/0120432 A1 6/2003 Zhou et al.
2004/0002818 A1 1/2004 Kulp et al.

(Continued)

FOREIGN PATENT DOCUMENTS

WO WO-2017017516 A1 * 2/2017 ........... C12Q 1/6886
WO WO-2019160914 A1 8/2019

OTHER PUBLICATIONS

Enard et al (Science 2002 vol. 296 p. 340) (Year: 2002).*
Extended European Search Report for European Application No. 21830303 mailed Dec. 18, 2024, 12 pages.
Kamoun A., et al., "A Consensus Molecular Classification of Muscle-invasive Bladder Cancer", European Urology, Elsevier, Amsterdam, NL, vol. 77, No. 4, Sep. 26, 2019 (Sep. 26, 2019), pp. 420-433.

(Continued)

*Primary Examiner* — Katherine D Salmon
(74) *Attorney, Agent, or Firm* — COOLEY LLP

(57) ABSTRACT

Provided herein are FGFR3 activation signatures for use in methods and compositions for predicting the response of a subject suffering from cancer to FGFR3 inhibitor therapy.

2 Claims, 26 Drawing Sheets

Specification includes a Sequence Listing.

(56) References Cited

U.S. PATENT DOCUMENTS

| | | | |
|---|---|---|---|
| 2004/0049354 | A1 | 3/2004 | Loraine et al. |
| 2004/0126840 | A1 | 7/2004 | Cheng et al. |
| 2005/0042654 | A1 | 2/2005 | Mei et al. |
| 2005/0079536 | A1 | 4/2005 | Su |
| 2005/0108197 | A1 | 5/2005 | Jevons et al. |
| 2005/0244883 | A1 | 11/2005 | Williams et al. |
| 2005/0250151 | A1 | 11/2005 | Mei et al. |
| 2018/0230545 | A1 | 8/2018 | Van Der Heijden et al. |
| 2021/0388449 | A1 | 12/2021 | Mayhew et al. |

OTHER PUBLICATIONS

Mayhew., et al. "Bladder cancer gene expression subtypes (60 gene signature) to define prognosis, differential immune response, and biomarker associations", Journal of Clinical Oncology, Grune & Stratton vol. 36, No. 15 May 20, 2018 (May 20, 2018), p. 4538.

Morales-Barrera R., et al., "The future of bladder cancer therapy: Optimizing the inhibition of the fibroblast growth factor receptor", Cancer Treatment Reviews, Elsevier, Amsterdam, NL, vol. 86, Mar. 13, 2020 (Mar. 13, 2020), 11 pages.

Barany, "Cloning, overexpression and nucleotide sequence of a thermostable DNA ligase-encoding gene," Proc. Natl. Acad. Sci. USA 88:189-193 (1991).

Bibikova et al., "Quantitative gene expression profiling in formalin-fixed, paraffin-embedded tissues using universal bead arrays," Am J. Pathol 165:1799-1807 (2004).

Bolstad et al., "A comparison of normalization methods for high density oligonucleotide array data based on variance and bias," Bioinformatics 19(2):185-193 (2003).

Brenner et al., "Gene expression analysis by massively parallel signature sequencing (MPSS) on microbead arrays," Nat. Biotech. 18:630-634 (2000).

Clark et al., "Suppression of nonspecific binding of avidin-biotin complex (ABC) to proteins electroblotted to nitrocellulose paper," J Histochem Cytochem 34:1509-1512 (1986).

Cronin et al., "Measurement of gene expression in archival paraffin-embedded tissues: development and performance of a 92-gene reverse transcriptase-polymerase chain reaction assay," Am. J Pathol. 164(1):35-42 (2004).

Dabney, "ClaNC: Point-and-click software for classifying microarrays tonearest centroids," Bioinformatics. 22: 122-123 (2006).

De Andres et al., "Improved method for mRNA extraction from paraffin-embedded tissues," BioTechniques 18:42-44 (1995).

Donnem T, et al. Prognostic impact of fibroblast growth factor 2 in non-small cell lung cancer: coexpression with VEGFR-3 and PDGF-B predicts poor survival. Journal of Thoracic Oncology 2009, 4(5):578-585.

Fan et al., "A Versatile Assay for High-Throughput Gene Expression Profiling on Universal Array Matrices," Genome Res. 14:878-885 (2004).

Fishel and Kaufman et al., "Meta-analysis of gene expression data: a predictor-based approach ," Bioinformatics 23(13): 1599-606 ( 2007).

Fox et al., "Formaldehyde Fixation," J Histochem Cytochem 33:845-853 (1985).

Friedman et al., "Regularization Paths for Generalized Linear Models via Coordinate Descent," Journal of statistical software 33(1): 1-22 (2010).

Geiss et al., "Direct multiplexed measurement of gene expression with color-coded probe pairs," Nat. Biotechnol., 2008, pp. 317-325.

Guatelli, et al., "Isothermal, in vitro amplification of nucleic acids by a multienzyme reaction modeled after retroviral replication," Proc Natl Acad Sci U S A. 87(5):1874-1878 (1990).

Gust KM, et al., "Fibroblast growth factor receptor 3 is a rational therapeutic target in bladder cancer," Molecular Cancer Therapeutics. 2013; 12(7):1245-1254.

Heist, RS et al. FGFRI Amplification in Squamous Cell Carcinoma of The Lung. Journal of Thoracic Oncology. 2012;7(12):1775-1780.

Hubbarad, "Protein tyrosine kinase structure and function," Annual Review of Biochemistry. 2000;69:373-398.

International Preliminary Report on Patentability for International Application No. PCT/US2021/038446 dated Jan. 5, 2023, 15 pages.

International Preliminary Report on Patentability issued by the International Searching Authority for Application No. PCT/US21/38446, dated Dec. 13, 2022, 14 pages.

International Search Report and Written Opinion for Application No. PCT/US2021/038446, mailed Jan. 6, 2022, 21 pages.

Invitation to Pay Additional Fees issued by the International Searching Authority for Application No. PCT/US21/38446, dated Oct. 27, 2021, 4 pages.

Irizarry et al., "Exploration, normalization, and summaries of high density oligonucleotide array probe level data," Biostatistics Apr. 4(2): 249-64 (2003).

Kanehisa, "Use of statistical criteria for screening potential homologies in nucleic acid sequences.," Nucleic Acids Res. 12:203-213 (1984).

Katoh et al., "FGF Receptors: Cancer Biology and Therapeutics," Med Res Rev. 2013; 34:280-300.

Kwoh et al., "Transcription-based amplification system and detection of amplified human immunodeficiency virus type 1 with a bead-based sandwich hybridization format (TI RNA polymerase/in vitro nucleic acid amplification) ," Proc. Natl. Acad. Sci. USA, 86:1173-1177 (1989).

Landegren et al., "A ligase-mediated gene detection technique," Science, 241(4869):1077-1080 (1988), retrieved from http://science.sciencemag.org/ on Oct. 29, 2018.

Mcghee and Von Hippel, "Formaldehyde as a probe of DNA structure. II. Reaction with endocyclic amino groups of DNA bases," Biochemistry 14:1281-1296 (1975).

Meyer D., "Support vector machines: the interface to libsvm in package e1071," 2014, 8 pages (dated Jul. 23, 2018).

Mullins et al., "Agreement in breast cancer classification between microarray and quantitative reverse transcription PCR from fresh-frozen and formalin-fixed, paraffin-embedded tissues," Clin Chem. 53(7):1273-1279 (2007).

Robin et al., "PROC: an open source package for R and S+ to analyze and compare ROC curves," BMC bioinformatic 12:77 (2011), 8 pages.

Rouskin et al., "Genome-wide probing of RNA structure reveals active unfolding of mRNA structures in vivo," Nature 505, pp. 701-705 (2014).

Rupp G and Locker J., University of Pittsburgh School of Medicine, "Purification and analysis of RNA from paraffin embedded tissues," BioTechniques 6(1):56-60 (1988).

Smyth, G. K., Limma: linear models for microarray data. In: Bioinformatics and Computational Biology Solutions using Rand Bioconductor, R. Gentleman, V. Carey, S. Dudoit, R. Irizarry, W. Huber (eds.), Springer, New York, pp. 397-420 (2005).

Smyth, G. K., "Linear Models and Empirical Bayes Methods for Assessing Differential Expression in Microarray Experiments," Stat. Appi. Genet. Mol. Biol. 3: Article 3 (2004), 28 pages.

Suykens Jak, Vandewalle J., "Least Squares Support Vector Machine Classifiers," Neural Processing Letters 9(3): 293-300 (1999).

Szumilas, "Explaining odds ratios," J. Can. Acad. Child Adolesc. Psychiatry 19(3): 227-229 (2010).

Tian Y., et al., "Glioma-Derived Endothelial Cells Promote Glioma Cells Migration via Extracellular Vesicles-Mediated Transfer of MYO1C," Biochemical and Biophysical Research Communications, Apr. 23, 2020, vol. 525(1), pp. 155-161.

Tibshirani et al., "Diagnosis of multiple cancer types by shrunken centroids of gene expression," Proc. Natl. Acad. Sci. USA 99(10):6576-6572 (2002).

Trapnell et al., "TopHat: discovering splice junctions with RNA-Seq.," Bioinformatics 25(9):1105-11 (2009).

Turner et al., "FGFRI amplification drives endocrine therapy resistance and is a therapeutic target in breast cancer," Cancer Research. 2010;70:2085-2094.

Velculescu et al., "Characterization of the yeast transcriptome," Cell 88(2):243-251 (1997).

Ware et al., "A mechanism of resistance to gefitinib mediated by cellular reprogramming and the acquisition of an FGF2-FGFR1 autocrine growth loop," Oncogenesis. 2013;2(3):e39, pp. 1-9.

(56) References Cited

OTHER PUBLICATIONS

Wu and Wallace, "The ligation amplification reaction (LAR)—amplification of specific DNA sequences using sequential rounds of template dependent ligation.," Genomics, 4(4):560-569 (1989).

* cited by examiner

FIG. 3

```
[1] TRUE
[1] ====== train ======
[1]
[1] FGFR3 mutation (rows) vs prediction (using 130 genes)
[1] Agreement: 0.85

      no yes Sum
 no   49  13  62
 yes   0  27  27
 Sum  49  40  89
[1]
[1] TRUE
[1] ====== test ======
[1]
[1] FGFR3 mutation (rows) vs prediction (using 130 genes)
[1] Agreement: 0.84

       no yes Sum
 no   253  38 291
 yes   12  16  28
 Sum  265  54 319
[1]
```

FIG. 6

```
[1] ====== train ======
[1]
[1] FGFR3 mutation (rows) vs prediction (using 80 genes)
[1] Agreement: 0.62

       no yes Sum
  no  134 102 236
  yes   2  34  36
  Sum 136 136 272
[1]
[1] FALSE
[1] ====== test ======
[1]
[1] FGFR3 mutation (rows) vs prediction (using 80 genes)
[1] Agreement: 0.62

       no yes Sum
  no   70  47 117
  yes   4  15  19
  Sum  74  62 136
[1]
```

FIG. 23 (continued)

Clinical response to BCG by FGFR3 alteration or FGFR3-AS Classifier (i)

| | | BCG Failure | | |
|---|---|---|---|---|
| | | *No* | *Yes* | *Sum* |
| FGFR3 Alteration Status | *Not-Altered* | 38 | 35 | 73 |
| | *Altered* | 15 | 10 | 25 |
| | *Sum* | 53 | 45 | 98 |

p = 0.6
Fisher's Exact test

| | | BCG Failure | | |
|---|---|---|---|---|
| | | *No* | *Yes* | *Sum* |
| FGFR3-AS Classifier (i) Status | *Negative* | 17 | 30 | 47 |
| | *Positive* | 51 | 31 | 82 |
| | *Sum* | 68 | 61 | 129 |

p = 0.006
Fisher's Exact test

METHODS FOR SELECTING AND TREATING CANCER WITH FGFR3 INHIBITORS

CROSS-REFERENCE TO RELATED APPLICATIONS

This application is a U.S. National Stage of International Application No. PCT/US2021/038446. filed Jun. 22, 2021, which claims the benefit of priority to U.S. Provisional Application No. 63/042,309, filed Jun. 22, 2020, which is herein incorporated by reference in its entirety for all purposes.

FIELD

The present invention relates to methods for determining a fibroblast growth factor recept-3 (FGFR3) mutational status using a gene expression signature on a sample obtained from a subject suffering from or suspected of suffering from cancer. The present invention also relates to methods of determining the potential efficacy of an FGFR3 inhibitor for treating a subject suffering from or suspected of suffering from cancer based on said patient's FGFR3 mutational status determined using one or more FGFR3 gene expression-based activation signatures.

STATEMENT REGARDING SEQUENCE LISTING

The Sequence Listing associated with this application is provided in text format in lieu of a paper copy and is hereby incorporated by reference into the specification. The name of the text file containing the Sequence Listing is GNCN_020_02WO_SeqList_ST25.txt. The text file is 2,048,000 bytes, and was created on Jun. 22, 2021, and is being submitted electronically via EFS-Web.

BACKGROUND

Fibroblast growth factor receptors (FGFRs) are highly conserved, widely distributed transmembrane tyrosine kinase receptors. They are involved in development, differentiation, cell survival, migration, angiogenesis, and carcinogenesis. In humans, there are four (4) such FGFRs that are typical tyrosine kinase receptors (FGFR1-4), and one that lacks an intracellular tyrosine kinase domain (FGFRL1 or FGFR5). There are also 18 human ligands for FGFRs, which are known as fibroblast growth factors (see Katoh M et al., FGF Receptors: Cancer Biology and Therapeutics. Med Res Rev. 2013; 34:280-300). All four FGFRs share structural homology with vascular endothelial growth factor receptors (VEGFRs), platelet-derived growth factor receptors (PDGFRs), and other tyrosine kinase receptors, which has implications for pharmacologic therapy (see Hubbard S R, Till J H. Protein tyrosine kinase structure and function. Annual Review of Biochemistry. 2000; 69:373-98).

Specific FGFR aberrations have been observed in a proportion of certain cancers such as, for example, FGFR3 mutations in bladder cancer (see Gust K M, et al. Fibroblast growth factor receptor 3 is a rational therapeutic target in bladder cancer. Molecular Cancer Therapeutics. 2013; 12:1245-54) and FGFR1 amplification in squamous cell lung cancer (see Heist R S, et al. FGFR1 Amplification in Squamous Cell Carcinoma of The Lung. Journal of Thoracic Oncology. 2012; 7:1775-80). Some of these FGFR abnormalities are likely to be "driver" aberrations. There is also evidence that changes in specific FGFR expression may be related to cancer prognosis or sensitivity to cancer treatments (see Donnem T, et al. Prognostic impact of fibroblast growth factor 2 in non-small cell lung cancer: coexpression with VEGFR-3 and PDGF-B predicts poor survival. J Thorac Oncol. 2009; 4:578-85; Turner N, et al. FGFR1 amplification drives endocrine therapy resistance and is a therapeutic target in breast cancer. Cancer Research. 2010; 70:2085-94; Ware K E, et al. A mechanism of resistance to gefitinib mediated by cellular reprogramming and the acquisition of an FGF2-FGFR1 autocrine growth loop. Oncogenesis. 2013; 2:e39). Since the majority of FGFR aberrations identified to date lead to gain-of-function, it is reasonable to hypothesize that targeting cancers with FGFR aberrations with FGFR inhibitors would be therapeutically beneficial. However, the challenge or problem becomes a means or method for effectively and efficiently defining patient populations that will be more or less susceptible to the numerous anti-FGFR drugs in development for cancer.

The methods, compositions and kits provided herein have been developed to address this need.

SUMMARY

In one aspect, provided herein is a method of determining whether a patient suffering from cancer is likely to respond to treatment with a fibroblast growth factor receptor (FGFR) inhibitor, the method comprising, determining a fibroblast growth factor receptor-3 (FGFR3) activation signature of a sample obtained from a patient suffering from cancer; and based on the FGFR3 activation signature, assessing whether the patient is likely to respond to treatment with an FGFR inhibitor, wherein a positive FGFR3 activation signature indicates presence of one or more mutations in an fgfr gene and predicts that the patient is likely to respond to the treatment with the FGFR inhibitor. In some cases, the fgfr gene is an fgfr3 gene. In some cases, the one or more mutations are oncogenic mutations. In some cases, the one or more mutations are oncogenic mutations in the fgfr3 gene. In some cases, the FGFR inhibitor shows inhibitory activity toward fibroblast growth factor receptor-3 (FGFR3). In some cases, the FGFR inhibitor is a tyrosine kinase inhibitor. In some cases, the FGFR inhibitor is a selective tyrosine kinase inhibitor. In some cases, the FGFR inhibitor is a non-selective tyrosine kinase inhibitor. In some cases, the FGFR inhibitor is selected from the group consisting of erdafitinib (JNJ 42756493), infigratinib (BGJ398), Rogaritinib (BAY 1163877), AZD4547, Pemigatinib (INCB54828), TAS-120, LY2874455, DEBIO 1347, PD173074, BLU9931, pazopanib, brivanib, ponatinib (AP24534), regorafenib (BAY 73-4506), lenvatinib (E7080), dovitinib (TKI258), lucitanib (E3810), nintedanib (BIBF 1120), Foretinib, and any combination thereof. In some cases, the FGFR inhibitor is nintedanib (BIBF 1120). In some cases, the FGFR inhibitor is an antibody or antibody-conjugate. In some cases, the FGFR inhibitor is B-701 or MFGR1877S. In some cases, the FGFR inhibitor is LY3076226. In some cases, the cancer the patient is suffering from is selected from the group consisting of breast cancer (BRCA), pancreatic adenocarcinoma (PAAD), lung adenocarcinoma (LUAD), lung squamous cell carcinoma (LUSC), urothelial carcinoma, endometrial cancer, renal cancer, gliomas, ovarian cancer, colorectal cancer, neuroendocrine cancer, sarcomas and head and neck squamous cell carcinoma (HNSCC). In some cases, the urothelial cancer is bladder cancer (BLCA), muscle invasive bladder cancer (MIBC), renal pelvis cancer, ureteral cancer, or urothelial carcinomas not otherwise specified (NOS). In some cases, the cancer the patient is suffering from is selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM. In some cases, the sample is a formalin-fixed, paraffin-embedded (FFPE) tissue sample, fresh or a frozen tissue sample, an exosome, or a bodily fluid obtained from the patient. In some cases, the bodily fluid is blood or fractions thereof, urine, saliva, or sputum. In some cases, the determining the FGFR3 activation signature of the sample obtained from the patient suffering from cancer comprises determining expression levels of a plurality of classifier biomarkers selected from Table 1 or Table 2. In some cases, the determining the expression levels of the plurality of classifier biomarkers is at a nucleic acid level by performing RNA sequencing, reverse transcriptase polymerase chain reaction (RT-PCR) or hybridization-based analyses. In some cases, the RT-PCR is quantitative real time reverse transcriptase polymerase chain reaction (qRT-PCR). In some cases, the RT-PCR is performed with primers specific to the classifier biomarkers selected from the plurality of classifier biomarkers of Table 1 or Table 2. In some cases, the hybridization analysis is a microarray-based hybridization analysis. In some cases, the method further comprises comparing the expression levels of the plurality of classifier biomarkers of Table 1 or Table 2 to an expression level of the plurality of classifier biomarkers of Table 1 or Table 2 in at least one sample training set, wherein the at least one sample training set is from a reference FGFR3 mutation-containing cancer sample, or is from a reference FGFR3 mutation-free cancer sample; and classifying the sample as having a positive FGFR3 activation signature based on the results of the comparing step. In some cases, the comparing comprises applying a statistical algorithm that comprises determining a correlation between the expression levels of the plurality of classifier biomarkers of Table 1 or Table 2 obtained from the sample and the expression levels of the plurality of classifier biomarkers of Table 1 or Table 2 from the at least one training set; and classifying the sample as possessing a positive FGFR3 activation signature based on the results of the statistical algorithm. In some cases, the at least one training set is from a reference FGFR3 mutation-containing cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample. In some cases, the at least one training set is from a reference FGFR3 mutation-containing cancer sample and from a reference FGFR3 mutation-free cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample. In some cases, the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes, at least 80 classifier genes, at least 90 classifier genes, at least 100 classifier genes, at least 110 classifier genes, at least 120 classifier genes or at least 130 classifier genes of Table 1. In some cases, the plurality of biomarker nucleic acids comprises, consists essentially of or consists of all the classifier biomarker nucleic acids of Table 1. In some cases, the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes or at least 80 classifier genes of Table 2. In some cases, the plurality of biomarker nucleic acids comprises, consists essentially of or consists of all the classifier biomarker nucleic acids of Table 2. In some cases, the determining the FGFR3 activation signature of the sample obtained from the patient comprises measuring an expression level of gene A and gene B for a plurality of biomarker gene pairs selected from Table 3 or Table 4. In some cases, the method further comprises determining a score for the sample by summing a classifier model intercept and coefficients from Table 3 or Table 4 for each gene pair from the plurality of biomarker gene pairs selected from Table 3 or Table 4 where the expression level of gene A is greater than the expression level of gene B, wherein the sample is deemed to have a positive FGFR3 activation signature if the score is calculated to be above zero. In some cases, the measuring the expression levels of gene A and gene B for the plurality of biomarker gene pairs selected from Table 3 or Table 4 is at a nucleic acid level by performing RNA sequencing, reverse transcriptase polymerase chain reaction (RT-PCR) or hybridization-based analyses. In some cases, the RT-PCR is quantitative real time reverse transcriptase polymerase chain reaction (qRT-PCR). In some cases, the RT-PCR is performed with primers specific to each gene in a gene pair from the plurality of biomarker gene pairs of Table 3 or Table 4. In some cases, the hybridization analysis is a microarray-based hybridization analysis. In some cases, the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs, at least 80 biomarker gene pairs, at least 90 biomarker gene pairs, at least 100 classifier genes or at least 112 biomarker gene pairs of Table 3. In some cases, the plurality of biomarker gene pairs comprises, consists essentially of or consists of all the biomarker gene pairs of Table 3. In some cases, the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs or at least 73 biomarker gene pairs of Table 4. In some cases, the plurality of biomarker gene pairs comprises, consists essentially of or consists of all the biomarker gene pairs of Table 4.

In another aspect, provided herein is a method for selecting a patient suffering from cancer for treatment with an FGFR inhibitor, the method comprising, determining an FGFR3 activation signature of a sample obtained from a patient suffering from cancer; and selecting the patient for treatment with an FGFR inhibitor if the FGFR3 activation signature is positive, wherein the positive FGFR3 activation signature indicates presence of one or more mutations in an fgfr gene. In some cases, the fgfr gene is an fgfr3 gene. In some cases, the one or more mutations are oncogenic mutations. In some cases, the one or more mutations are oncogenic mutations in the fgfr3 gene. In some cases, the patient is selected for treatment with an FGFR inhibitor alone or in combination with an additional therapy or therapies. The additional therapy or therapies can be selected from the group consisting of a chemotherapeutic agent, an angiogenesis inhibitor, immunotherapy, radiotherapy, surgical intervention and any combination thereof. In some cases, the FGFR inhibitor shows inhibitory activity toward fibroblast growth factor receptor-3 (FGFR3). In some cases, the FGFR inhibitor is a tyrosine kinase inhibitor. In some cases, the FGFR inhibitor is a selective tyrosine kinase inhibitor. In some cases, the FGFR inhibitor is a non-selective tyrosine kinase inhibitor. In some cases, the FGFR inhibitor is selected from the group consisting of erdafitinib (JNJ 42756493), infigratinib (BGJ398), Rogaritinib (BAY 1163877), AZD4547, Pemigatinib (INCB54828), TAS-120, LY2874455, DEBIO 1347, PD173074, BLU9931, pazopanib, brivanib, ponatinib (AP24534), regorafenib (BAY 73-4506), lenvatinib (E7080), dovitinib (TKI258), lucitanib (E3810), nintedanib (BIBF 1120), Foretinib, and any combination thereof. In some cases, the FGFR inhibitor is nintedanib (BIBF 1120). In some cases, the FGFR inhibitor is an antibody or antibody-conjugate. In some cases, the FGFR inhibitor is B-701 or MFGR1877S. In some cases, the FGFR inhibitor is LY3076226. In some cases, the cancer the patient is suffering from is selected from the group consisting of breast cancer (BRCA), pancreatic adenocarcinoma (PAAD), lung adenocarcinoma (LUAD), lung squamous cell carcinoma (LUSC), urothelial carcinoma, endometrial cancer, renal cancer, gliomas, ovarian cancer, colorectal cancer, neuroendocrine cancer, sarcomas and head and neck squamous cell carcinoma (HNSCC). In some cases, the urothelial cancer is bladder cancer (BLCA), muscle invasive bladder cancer (MIBC), renal pelvis cancer, ureteral cancer, or urothelial carcinomas not otherwise specified (NOS). In some cases, the cancer the patient is suffering from is selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM. In some cases, the sample is a formalin-fixed, paraffin-embedded (FFPE) tissue sample, fresh or a frozen tissue sample, an exosome, or a bodily fluid obtained from the patient. In some cases, the bodily fluid is blood or fractions thereof, urine, saliva, or sputum. In some cases, the determining the FGFR3 activation signature of the sample obtained from the patient suffering from cancer comprises determining expression levels of a plurality of classifier biomarkers selected from Table 1 or Table 2. In some cases, the determining the expression levels of the plurality of classifier biomarkers is at a nucleic acid level by performing RNA sequencing, reverse transcriptase polymerase chain reaction (RT-PCR) or hybridization-based analyses. In some cases, the RT-PCR is quantitative real time reverse transcriptase polymerase chain reaction (qRT-PCR). In some cases, the RT-PCR is performed with primers specific to the classifier biomarkers selected from the plurality of classifier biomarkers of Table 1 or Table 2. In some cases, the hybridization analysis is a microarray-based hybridization analysis. In some cases, the method further comprises comparing the expression levels of the plurality of classifier biomarkers of Table 1 or Table 2 to an expression level of the plurality of classifier biomarkers of Table 1 or Table 2 in at least one sample training set, wherein the at least one sample training set is from a reference FGFR3 mutation-containing cancer sample, or is from a reference FGFR3 mutation-free cancer sample; and classifying the sample as having a positive FGFR3 activation signature based on the results of the comparing step. In some cases, the comparing comprises applying a statistical algorithm that comprises determining a correlation between the expression levels of the plurality of classifier biomarkers of Table 1 or Table 2 obtained from the sample and the expression levels of the plurality of classifier biomarkers of Table 1 or Table 2 from the at least one training set; and classifying the sample as possessing a positive FGFR3 activation signature on the results of the statistical algorithm. In some cases, the at least one training set is from a reference FGFR3 mutation-containing cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample. In some cases, the at least one training set is from a reference FGFR3 mutation-containing cancer sample and from a reference FGFR3 mutation-free cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample. In some cases, the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes, at least 80 classifier genes, at least 90 classifier genes, at least 100 classifier genes, at least 110 classifier genes, at least 120 classifier genes or at least 130 classifier genes of Table 1. In some cases, the plurality of biomarker nucleic acids comprises, consists essentially of or consists of all the classifier biomarker nucleic acids of Table 1. In some cases, the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes or at least 80 classifier genes of Table 2. In some cases, the plurality of biomarker nucleic acids comprises, consists essentially of or consists of all the classifier biomarker nucleic acids of Table 2. In some cases, the determining the FGFR3 activation signature of the sample obtained from the patient comprises measuring an expression level of gene A and gene B for a plurality of biomarker gene pairs selected from Table 3 or Table 4. In some cases, the method further comprises determining a score for the sample by summing a classifier model intercept and coefficients from Table 3 or Table 4 for each gene pair from the plurality of biomarker gene pairs selected from Table 3 or Table 4 where the expression level of gene A is greater than the expression level of gene B, wherein the sample is deemed to have a positive FGFR3 activation signature if the score is calculated to be above zero. In some cases, the measuring the expression levels of gene A and gene B for the plurality of biomarker gene pairs selected from Table 3 or Table 4 is at a nucleic acid level by performing RNA sequencing, reverse transcriptase polymerase chain reaction (RT-PCR) or hybridization-based analyses. In some cases, the RT-PCR is quantitative real time reverse transcriptase polymerase chain reaction (qRT-PCR). In some cases, the RT-PCR is performed with primers specific to each gene in a gene pair from the plurality of biomarker gene pairs of Table 3 or Table 4. In some cases, the hybridization analysis is a microarray-based hybridization analysis. In some cases, the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs, at least 80 biomarker gene pairs, at least 90 biomarker gene pairs, at least 100 classifier genes or at least 112 biomarker gene pairs of Table 3. In some cases, the plurality of biomarker gene pairs comprises, consists essentially of or consists of all the biomarker gene pairs of Table 3. In some cases, the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs or at least 73 biomarker gene pairs of Table 4. In some cases, the plurality of biomarker gene pairs comprises, consists essentially of or consists of all the biomarker gene pairs of Table 4.

In one aspect, provided herein is a method of treating cancer in a patient, the method comprising: measuring the expression level of a plurality of classifier biomarkers in a sample obtained from a patient suffering from cancer, wherein the plurality of classifier biomarkers are selected from a set of biomarkers listed in Table 1 or Table 2, wherein the measured expression levels of the plurality of classifier biomarkers provide an FGFR3 activation signature for the sample; and administering an FGFR inhibitor based on presence of a positive FGFR3 activation signature, wherein the positive FGFR3 activation signature is indicative of presence of one or more mutations in an fgfr gene. In some cases, the fgfr gene is an fgfr3 gene. In some cases, the one or more mutations are oncogenic mutations. In some cases, the one or more mutations are oncogenic mutations in the fgfr3 gene. In some cases, the measuring the expression levels of the plurality of classifier biomarkers is at a nucleic acid level by performing RNA sequencing, reverse transcriptase polymerase chain reaction (RT-PCR) or hybridization-based analyses. In some cases, the RT-PCR is quantitative real time reverse transcriptase polymerase chain reaction (qRT-PCR). In some cases, the RT-PCR is performed with primers specific to the classifier biomarkers selected from the plurality of classifier biomarkers of Table 1 or Table 2. In some cases, the hybridization analysis is a microarray-based hybridization analysis. In some cases, the method further comprises comparing the expression levels of the plurality of classifier biomarkers of Table 1 or Table 2 to an expression level of the plurality of classifier biomarkers of Table 1 or Table 2 in at least one sample training set, wherein the at least one sample training set is from a reference FGFR3 mutation-containing cancer sample, or is from a reference FGFR3 mutation-free cancer sample; and classifying the tumor sample as having a positive FGFR3 activation signature based on the results of the comparing step. In some cases, the comparing comprises applying a statistical algorithm that comprises determining a correlation between the expression levels of the plurality of classifier biomarkers of Table 1 or Table 2 obtained from the sample and the expression levels of the plurality of classifier biomarkers of Table 1 or Table 2 from the at least one training set; and classifying the tumor sample as possessing a positive FGFR3 activation signature on the results of the statistical algorithm. In some cases, the at least one training set is from a reference FGFR3 mutation-containing cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample. In some cases, the at least one training set is from a reference FGFR3 mutation-containing cancer sample and from a reference FGFR3 mutation-free cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample. In some cases, the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes, at least 80 classifier genes, at least 90 classifier genes, at least 100 classifier genes, at least 110 classifier genes, at least 120 classifier genes or at least 130 classifier genes of Table 1. In some cases, the plurality of biomarker nucleic acids comprises, consists essentially of or consists of all the classifier biomarker nucleic acids of Table 1. In some cases, the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes or at least 80 classifier genes of Table 2. In some cases, the plurality of biomarker nucleic acids comprises, consists essentially of or consists of all the classifier biomarker nucleic acids of Table 2. In some cases, the FGFR inhibitor is administered alone or in combination with an additional therapy or therapies. The additional therapy or therapies can be selected from the group consisting of a chemotherapeutic agent, an angiogenesis inhibitor, immunotherapy, radiotherapy, surgical intervention and any combination thereof. In some cases, the FGFR inhibitor shows inhibitory activity toward fibroblast growth factor receptor-3 (FGFR3). In some cases, the FGFR inhibitor is a tyrosine kinase inhibitor. In some cases, the FGFR inhibitor is a selective tyrosine kinase inhibitor. In some cases, the FGFR inhibitor is a non-selective tyrosine kinase inhibitor. In some cases, the FGFR inhibitor is selected from the group consisting of erdafitinib (JNJ 42756493), infigratinib (BGJ398), Rogaritinib (BAY 1163877), AZD4547, Pemigatinib (INCB54828), TAS-120, LY2874455, DEBIO 1347, PD173074, BLU9931, pazopanib, brivanib, ponatinib (AP24534), regorafenib (BAY 73-4506), lenvatinib (E7080), dovitinib (TKI258), lucitanib (E3810), nintedanib (BIBF 1120), Foretinib, and any combination thereof. In some cases, the FGFR inhibitor is nintedanib (BIBF 1120). In some cases, the FGFR inhibitor is an antibody or antibody-conjugate. In some cases, the FGFR inhibitor is B-701 or MFGR1877S. In some cases, the FGFR inhibitor is LY3076226. In some cases, the cancer the patient is suffering from is selected from the group consisting of breast cancer (BRCA), pancreatic adenocarcinoma (PAAD), lung adenocarcinoma (LUAD), lung squamous cell carcinoma (LUSC), urothelial carcinoma, endometrial cancer, renal cancer, gliomas, ovarian cancer, colorectal cancer, neuroendocrine cancer, sarcomas and head and neck squamous cell carcinoma (HNSCC). In some cases, the urothelial cancer is bladder cancer (BLCA), muscle invasive bladder cancer (MIBC), renal pelvis cancer, ureteral cancer, or urothelial carcinomas not otherwise specified (NOS). In some cases, the cancer the patient is suffering from is selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM. In some cases, the sample is a formalin-fixed, paraffin-embedded (FFPE) tissue sample, fresh or a frozen tissue sample, an exosome, or a bodily fluid obtained from the patient. In some cases, the bodily fluid is blood or fractions thereof, urine, saliva, or sputum.

In another embodiment, provided herein is a method of treating cancer in a patient, the method comprising: measuring an expression level of gene A and gene B for a plurality of biomarker gene pairs selected from Table 3 or Table 4 in a tumor sample obtained from a patient suffering from cancer, wherein the measured expression levels of gene A and gene B for the plurality of biomarker gene pairs selected from Table 3 or Table 4 provide an FGFR3 activation signature for the sample; and administering an FGFR inhibitor based on presence of a positive FGFR3 activation signature, wherein the positive FGFR3 activation signature is indicative of presence of one or more mutations in an fgfr gene. In some cases, the fgfr gene is an fgfr3 gene. In some cases, the one or more mutations are oncogenic mutations. In some cases, the one or more mutations are oncogenic mutations in the fgfr3 gene. In some cases, the method further comprises determining a score for the sample by summing a classifier model intercept and coefficients from Table 3 or Table 4 for each gene pair from the plurality of biomarker gene pairs selected from Table 3 or Table 4 where the expression level of gene A is greater than the expression level of gene B, wherein the sample is deemed to have a positive FGFR3 activation signature if the score is calculated to be above zero. In some cases, the measuring the expression levels of the plurality of classifier biomarkers is at a nucleic acid level by performing RNA sequencing, reverse transcriptase polymerase chain reaction (RT-PCR) or hybridization-based analyses. In some cases, the RT-PCR is quantitative real time reverse transcriptase polymerase chain reaction (qRT-PCR). In some cases, the RT-PCR is performed with primers specific to each gene in a gene pair from the plurality of biomarker gene pairs of Table 3 or Table 4. In some cases, the hybridization analysis is a microarray-based hybridization analysis. In some cases, the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs, at least 80 biomarker gene pairs, at least 90 biomarker gene pairs, at least 100 classifier genes or at least 112 biomarker gene pairs of Table 3. In some cases, the plurality of biomarker gene pairs comprises, consists essentially of or consists of all the biomarker gene pairs of Table 3. In some cases, the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs or at least 73 biomarker gene pairs of Table 4. In some cases, the plurality of biomarker gene pairs comprises, consists essentially of or consists of all the biomarker gene pairs of Table 4. In some cases, the FGFR inhibitor is administered alone or in combination with an additional therapy or therapies. The additional therapy or therapies can be selected from the group consisting of a chemotherapeutic agent, an angiogenesis inhibitor, immunotherapy, radiotherapy, surgical intervention and any combination thereof. In some cases, the FGFR inhibitor shows inhibitory activity toward fibroblast growth factor receptor-3 (FGFR3). In some cases, the FGFR inhibitor is a tyrosine kinase inhibitor. In some cases, the FGFR inhibitor is a selective tyrosine kinase inhibitor. In some cases, the FGFR inhibitor is a non-selective tyrosine kinase inhibitor. In some cases, the FGFR inhibitor is selected from the group consisting of erdafitinib (JNJ 42756493), infigratinib (BGJ398), Rogaritinib (BAY 1163877), AZD4547, Pemigatinib (INCB54828), TAS-120, LY2874455, DEBIO 1347, PD173074, BLU9931, pazopanib, brivanib, ponatinib (AP24534), regorafenib (BAY 73-4506), lenvatinib (E7080), dovitinib (TKI258), lucitanib (E3810), nintedanib (BIBF 1120), Foretinib, and any combination thereof. In some cases, the FGFR inhibitor is nintedanib (BIBF 1120). In some cases, the FGFR inhibitor is an antibody or antibody-conjugate. In some cases, the FGFR inhibitor is B-701 or MFGR1877S. In some cases, the FGFR inhibitor is LY3076226. In some cases, the cancer the patient is suffering from is selected from the group consisting of breast cancer (BRCA), pancreatic adenocarcinoma (PAAD), lung adenocarcinoma (LUAD), lung squamous cell carcinoma (LUSC), urothelial carcinoma, endometrial cancer, renal cancer, gliomas, ovarian cancer, colorectal cancer, neuroendocrine cancer, sarcomas and head and neck squamous cell carcinoma (HNSCC). In some cases, the urothelial cancer is bladder cancer (BLCA), muscle invasive bladder cancer (MIBC), renal pelvis cancer, ureteral cancer, or urothelial carcinomas not otherwise specified (NOS). In some cases, the cancer the patient is suffering from is selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM. In some cases, the sample is a formalin-fixed, paraffin-embedded (FFPE) tissue sample, fresh or a frozen tissue sample, an exosome, or a bodily fluid obtained from the patient. In some cases, the bodily fluid is blood or fractions thereof, urine, saliva, or sputum.

In one aspect, provided herein is a method of detecting a biomarker in a sample obtained from a patient suffering from cancer, the method comprising, consisting essentially of or consisting of measuring the expression level of a plurality of biomarker nucleic acids selected from Table 1 or Table 2 using an amplification, hybridization and/or sequencing assay. In some cases, the sample was previously diagnosed as being a cancer selected from bladder cancer, breast cancer, pancreatic adenocarcinoma, lung adenocarcinoma, lung squamous cell carcinoma, and head and neck adenocarcinoma. In some cases, the sample was previously diagnosed as being a cancer selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM. In some cases, the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques. In some cases, the expression level is detected by performing qRT-PCR. In some cases, the detection of the expression level comprises using at least one pair of oligonucleotide primers per each biomarker nucleic acid from the plurality of biomarker nucleic acids selected from Table 1 or Table 2. In some cases, the sample is a formalin-fixed, paraffin-embedded (FFPE) lung tissue sample, fresh or a frozen tissue sample, an exosome, wash fluids, cell pellets, or a bodily fluid obtained from the patient. In some cases, the bodily fluid is blood or fractions thereof, urine, saliva, or sputum. In some cases, the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes, at least 80 classifier genes, at least 90 classifier genes, at least 100 classifier genes, at least 110 classifier genes, at least 120 classifier genes or at least 130 classifier genes of Table 1. In some cases, the plurality of biomarker nucleic acids comprises, consists essentially of or consists of all the classifier biomarker nucleic acids of Table 1. In some cases, the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes or at least 80 classifier genes of Table 2. In some cases, the plurality of biomarker nucleic acids comprises, consists essentially of or consists of all the classifier biomarker nucleic acids of Table 2.

In another embodiment, provided herein is a method of detecting a biomarker in a tumor sample obtained from a patient suffering from cancer, the method comprising, consisting essentially of or consisting of measuring an expression level of gene A and gene B for a plurality of biomarker gene pairs selected from Table 3 or Table 4 using an amplification, hybridization and/or sequencing assay. In some cases, the tumor sample was previously diagnosed as being a cancer selected from bladder cancer, breast cancer, pancreatic adenocarcinoma, lung adenocarcinoma, lung squamous cell carcinoma, and head and neck adenocarcinoma. In some cases, the sample was previously diagnosed as being a cancer selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM. In some cases, the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques. In some cases, the expression level is detected by performing qRT-PCR. In some cases, the detection of the expression level comprises using at least one pair of oligonucleotide primers per each biomarker nucleic acid in each biomarker gene pair from the plurality of biomarker gene pairs selected from Table 3 or Table 4. In some cases, the sample is a formalin-fixed, paraffin-embedded (FFPE) lung tissue sample, fresh or a frozen tissue sample, an exosome, wash fluids, cell pellets, or a bodily fluid obtained from the patient. In some cases, the bodily fluid is blood or fractions thereof, urine, saliva, or sputum. In some cases, the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs, at least 80 biomarker gene pairs, at least 90 biomarker gene pairs, at least 100 classifier genes or at least 112 biomarker gene pairs of Table 3. In some cases, the plurality of biomarker gene pairs comprises, consists essentially of or consists of all the biomarker gene pairs of Table 3. In some cases, the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs or at least 73 biomarker gene pairs of Table 4. In some cases, the plurality of biomarker gene pairs comprises, consists essentially of or consists of all the biomarker gene pairs of Table 4.

BRIEF DESCRIPTION OF THE DRAWINGS

FIG. 3 illustrates agreement and disagreement between the actual alteration status and the FGFR3 alteration status of the training set (n=89) as predicted by the 130 gene FGFR3 activation signature of Table 1 (top portion-overall agreement was 85%) as well as agreement and disagreement between the actual alteration status and the FGFR3 alteration status of the testing set (n=319) as predicted by the 130 gene FGFR3 activation signature of Table 1 (bottom portion-overall agreement was 84%).

FIG. 6 illustrates agreement and disagreement between the actual alteration status and the FGFR3 alteration status of the training set as predicted by the 80 gene FGFR3 activation signature of Table 2 (top portion-overall agreement was 62%) as well as agreement and disagreement between the actual alteration status and the FGFR3 alteration status of the testing set as predicted by the 80 gene FGFR3 activation signature of Table 2 (bottom portion-overall agreement was 62%).

DETAILED DESCRIPTION

Definitions

Figure 1:
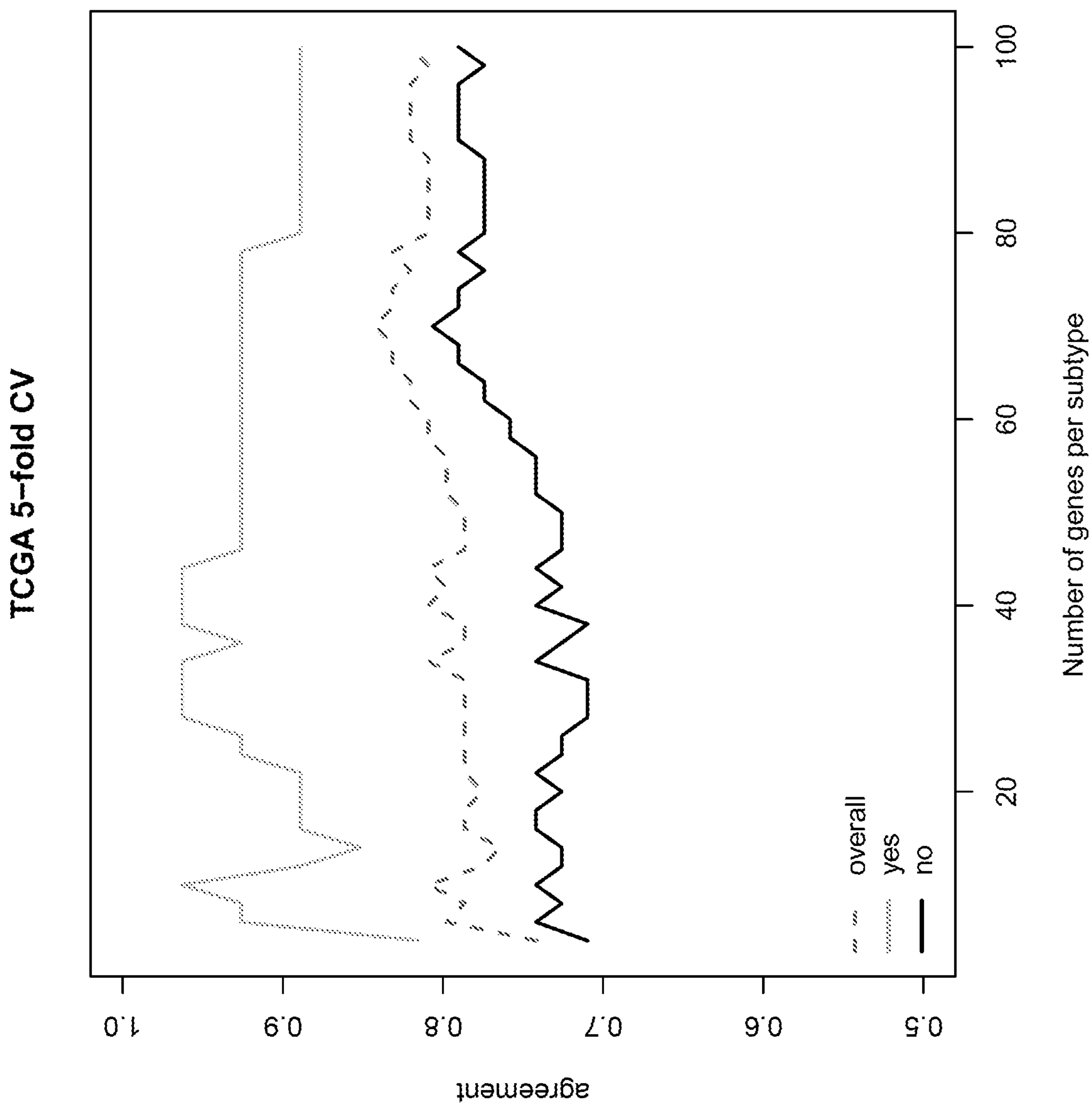
FIG. 1 illustrates five-fold cross validation curves using a Clanc plain algorithm on The Cancer Genome Atlas (TCGA) bladder cancer (BLCA) dataset (n=408) to guide the selection of the number of genes per FGFR3 activation signature status (i.e., positive or negative) to include in the signature of Table 1 for ascertaining FGFR3 alteration/activation status.

While the following terms are believed to be well understood by one of ordinary skill in the art, the following definitions are set forth to facilitate explanation of the presently disclosed subject matter.

As used herein, the singular forms "a", "an" and "the" are intended to include the plural forms as well, unless the context clearly indicates otherwise. Additionally, the use of "or" is intended to include "and/or" unless the context clearly indicates otherwise. Furthermore, to the extent that the terms "including", "includes", "having", "has", "with", or variants thereof are used in either the detailed description and/or the claims, such terms are intended to be inclusive in a manner similar to the term "comprising". The term "about" as used herein can refer to a range that is 15%, 10%, 8%, 6%, 4%, or 2% plus or minus from a stated numerical value.

Unless the context requires otherwise, throughout the present specification and claims, the word "comprise" and variations thereof, such as, "comprises" and "comprising" are to be construed in an open, inclusive sense that is as "including, but not limited to". The use of the alternative (e.g., "or") should be understood to mean either one, both, or any combination thereof of the alternatives. As used herein, the terms "about" and "consisting essentially of" mean+/−20% of the indicated range, value, or structure, unless otherwise indicated.

Reference throughout this specification to "one embodiment" or "an embodiment" means that a particular feature, structure or characteristic described in connection with the embodiment may be included in at least one embodiment of the present disclosure. Thus, the appearances of the phrases "in one embodiment" or "in an embodiment" in various places throughout this specification may not necessarily all be referring to the same embodiment. It is appreciated that certain features of the disclosure, which are, for clarity, described in the context of separate embodiments, may also be provided in combination in a single embodiment. Conversely, various features of the disclosure, which are, for brevity, described in the context of a single embodiment, may also be provided separately or in any suitable subcombination.

Throughout this disclosure, various aspects of the methods and compositions provided herein can be presented in a range format. It should be understood that the description in range format is merely for convenience and brevity and should not be construed as an inflexible limitation on the scope of the invention. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 3, 4, 5, and 6. This applies regardless of the breadth of the range.

Unless otherwise indicated, the methods and compositions provided herein can utilize conventional techniques and descriptions of organic chemistry, polymer technology, molecular biology (including recombinant techniques), cell biology, biochemistry, and immunology, which are within the skill of the art. Such conventional techniques include polymer array synthesis, hybridization, ligation, and detection of hybridization using a label. Specific illustrations of suitable techniques can be had by reference to the example herein below. However, other equivalent conventional procedures can, of course, also be used. Such conventional techniques and descriptions can be found in standard laboratory manuals such as Genome Analysis: A Laboratory Manual Series (Vols. I-IV), Using Antibodies: A Laboratory Manual, Cells: A Laboratory Manual, PCR Primer: A Laboratory Manual, and Molecular Cloning: A Laboratory Manual (all from Cold Spring Harbor Laboratory Press), Gait, "Oligonucleotide Synthesis: A Practical Approach" 1984, IRL Press, London, Nelson and Cox (2000), Lehninger et al., (2008) Principles of Biochemistry 5th Ed., W.H. Freeman Pub., New York, N.Y. and Berg et al. (2006) Biochemistry, 6.sup.th Ed., W.H. Freeman Pub., New York, N.Y., all of which are herein incorporated in their entirety by reference for all purposes.

Conventional software and systems may also be used in the methods and compositions provided herein. Computer software products of the invention typically include computer readable medium having computer-executable instructions for performing the logic steps of the method of the invention. Suitable computer readable medium include floppy disk, CD-ROM/DVD/DVD-ROM, hard-disk drive, flash memory, ROM/RAM, magnetic tapes, etc. The computer-executable instructions may be written in a suitable computer language or combination of several languages. Basic computational biology methods are described in, for example, Setubal and Meidanis et al., Introduction to Computational Biology Methods (PWS Publishing Company, Boston, 1997); Salzberg, Searles, Kasif, (Ed.), Computational Methods in Molecular Biology, (Elsevier, Amsterdam, 1998); Rashidi and Buehler, Bioinformatics Basics: Application in Biological Science and Medicine (CRC Press, London, 2000) and Ouelette and Bzevanis Bioinformatics: A Practical Guide for Analysis of Gene and Proteins (Wiley & Sons, Inc., 2.sup.nd ed., 2001). See U.S. Pat. No. 6,420,108.

The methods and compositions provided herein may also make use of various computer program products and software for a variety of purposes, such as probe design, management of data, analysis, and instrument operation. See, U.S. Pat. Nos. 5,593,839, 5,795,716, 5,733,729, 5,974,164, 6,066,454, 6,090,555, 6,185,561, 6,188,783, 6,223,127, 6,229,911 and 6,308,170. Computer methods related to genotyping using high-density microarray analysis may also be used in the present methods, see, for example, US Patent Pub. Nos. 20050250151, 20050244883, 20050108197, 20050079536 and 20050042654.

Additionally, the present disclosure may have preferred embodiments that include methods for providing genetic information over networks such as the Internet as shown in U.S. Patent Pub. Nos. 20030097222, 20020183936, 20030100995, 20030120432, 20040002818, 20040126840, and 20040049354.

As used herein, the term "individual", "patient", or "subject", can be used interchangeably and can refer to an individual regardless of health and/or disease status. A subject can be a subject, a study participant, a control subject, a screening subject, or any other class of individual from whom a sample can be obtained and assessed in the context of the invention. Accordingly, a subject can be diagnosed with a cancer (including subtypes, or grades thereof), can present with one or more symptoms of a cancer or a predisposing factor, such as a family (genetic) or medical history (medical) factor, for a cancer, can be undergoing treatment or therapy for a cancer, or the like. Alternatively, a subject can be healthy with respect to any of the aforementioned factors or criteria.

It will be appreciated that the term "healthy" as used herein, can be relative to a cancer status, as the term "healthy" cannot be defined to correspond to any absolute evaluation or status. Thus, an individual defined as healthy with reference to any specified disease or disease criterion can in fact be diagnosed with any other one or more diseases or exhibit any other one or more disease criterion including one or more other cancer types.

As used herein, the terms “individual,” “patient,” and “subject” can refer to any single animal, more preferably a mammal (including such non-human animals as, for example, dogs, cats, horses, rabbits, zoo animals, cows, pigs, sheep, and non-human primates) for which treatment is desired. In particular, embodiments, the individual or patient herein is a human.

Further to any of the embodiments provided herein, the cancer can include, but are not limited to, carcinoma, lymphoma, blastoma (including medulloblastoma and retinoblastoma), sarcoma (including liposarcoma and synovial cell sarcoma), neuroendocrine tumors (including carcinoid tumors, gastrinoma, and islet cell cancer), mesothelioma, schwannoma (including acoustic neuroma), meningioma, adenocarcinoma, melanoma, and leukemia or lymphoid malignancies. Examples of a cancer also include, but are not limited to, a lung cancer (e.g., a non-small cell lung cancer (NSCLC)), a kidney cancer (e.g., a kidney urothelial carcinoma or RCC), a bladder cancer (e.g., a bladder urothelial (transitional cell) carcinoma (e.g., locally advanced or metastatic urothelial cancer, including 1L or 2L+ locally advanced or metastatic urothelial carcinoma), a breast cancer, a colorectal cancer (e.g., a colon adenocarcinoma), an ovarian cancer, a pancreatic cancer (e.g., pancreatic adenocarcinoma or PAAD), a gastric carcinoma, an esophageal cancer, a mesothelioma, a melanoma (e.g., a skin melanoma), a head and neck cancer (e.g., a head and neck squamous cell carcinoma (HNSCC)), a thyroid cancer, a sarcoma (e.g., a soft-tissue sarcoma, a fibrosarcoma, a myxosarcoma, a liposarcoma, an osteogenic sarcoma, an osteosarcoma, a chondrosarcoma, an angiosarcoma, an endotheliosarcoma, a lymphangiosarcoma, a lymphangioendotheliosarcoma, a leiomyosarcoma, or a rhabdomyosarcoma), a prostate cancer, a glioblastoma, a cervical cancer, a thymic carcinoma, a leukemia (e.g., an acute lymphocytic leukemia (ALL), an acute myelocytic leukemia (AML), a chronic myelocytic leukemia (CML), a chronic eosinophilic leukemia, or a chronic lymphocytic leukemia (CLL)), a lymphoma (e.g., a Hodgkin lymphoma or a non-Hodgkin lymphoma (NHL)), a myeloma (e.g., a multiple myeloma (MM)), a mycosis fungoides, a Merkel cell cancer, a hematologic malignancy, a cancer of hematological tissues, a B cell cancer, a bronchus cancer, a stomach cancer, a brain or central nervous system cancer, a peripheral nervous system cancer, a uterine or endometrial cancer, a cancer of the oral cavity or pharynx, a liver cancer, a testicular cancer, a biliary tract cancer, a small bowel or appendix cancer, a salivary gland cancer, an adrenal gland cancer, an adenocarcinoma, an inflammatory myofibroblastic tumor, a gastrointestinal stromal tumor (GIST), a colon cancer, a myelodysplastic syndrome (MDS), a myeloproliferative disorder (MPD), a polycythemia Vera, a chordoma, a synovioma, an Ewing’s tumor, a squamous cell carcinoma, a basal cell carcinoma, an adenocarcinoma, a sweat gland carcinoma, a sebaceous gland carcinoma, a papillary carcinoma, a papillary adenocarcinoma, a medullary carcinoma, a bronchogenic carcinoma, a renal cell carcinoma, a hepatoma, a bile duct carcinoma, a choriocarcinoma, a seminoma, an embryonal carcinoma, a Wilms’ tumor, a bladder carcinoma, an epithelial carcinoma, a glioma, an astrocytoma, a medulloblastoma, a craniopharyngioma, an ependymoma, a pinealoma, a hemangioblastoma, an acoustic neuroma, an oligodendroglioma, a meningioma, a neuroblastoma, a retinoblastoma, a follicular lymphoma, a diffuse large B-cell lymphoma, a mantle cell lymphoma, a hepatocellular carcinoma, a thyroid cancer, a small cell cancer, an essential thrombocythemia, an agnogenic myeloid metaplasia, a hypereosinophilic syndrome, a systemic mastocytosis, a familiar hypereosinophilia, a neuroendocrine cancer, or a carcinoid tumor.

In some cases, the cancer is selected from an adrenocortical carcinoma (ACC), a cervical kidney renal papillary cell carcinoma (KIRP); breast invasive carcinoma (BRCA); thyroid cancer (THCA); bladder carcinoma (BLCA); a muscle invasive bladder cancer (MIBC); prostate adenocarcinoma (PRAD); kidney chromophobe (KICH); cervical squamous cell carcinoma and endocervical adenocarcinoma (CESC); kidney renal clear cell carcinoma (KIRC); liver hepatocellular carcinoma (LIHC); low grade glioma (LGG); sarcoma (SARC); lung adenocarcinoma (LUAD); colon adenocarcinoma (COAD); head-neck squamous cell carcinoma (HNSC); uterine corpus endometrial carcinoma (UCEC); glioblastoma multiforme (GBM); esophageal carcinoma (ESCA); stomach adenocarcinoma (STAD): ovarian cancer (OV); rectum adenocarcinoma (READ), lung squamous cell carcinoma (LUSC), pancreatic adenocarcinoma (PAAD), diffuse large B-cell lymphoma (DLBC), cholangiocarcinmoa (CHOL); sarcoma (SARC), skin cutaneous melanoma (SKCM), testicular germ cell tumors (TGCT), thymoma (THYM), uterine carcinosarcoma (UCS), uveal melanoma (UV M); pheochromocyotma and paraganglioma (PCPG), an esophageal cancer, a mesothelioma, a melanoma, a head and neck cancer, a thyroid cancer, a sarcoma, a prostate cancer, a glioblastoma, a cervical cancer, a thymic carcinoma, a leukemia, a lymphoma, a myeloma, a mycosis fungoides, a merkel cell cancer, an endometrial cancer. In some cases, the cancer is adrenocortical carcinoma (ACC), lung adenocarcinoma (LUAD), colon adenocarcinoma (COAD), breast invasive carcinoma (BRCA), uterine corpus endometrial carcinoma (UCEC), rectum adenocarcinoma (READ), pancreatic adenocarcinoma (PAAD), diffuse large B-cell lymphoma (DLBC), cholangiocarcinmoa (CHOL), sarcoma (SARC), skin cutaneous melanoma (SKCM), testicular germ cell tumors (TGCT), thymoma (THYM), uterine carcinosarcoma (UCS), uveal melanoma (UVM), pheochromocytoma and paraganglioma (PCPG) or lung squamous cell carcinoma (LUSC).

The term “nucleic acid” as used herein can refer to a polymeric form of nucleotides of any length, either ribonucleotides, deoxyribonucleotides or peptide nucleic acids (PNAs), that comprise purine and pyrimidine bases, or other natural, chemically or biochemically modified, non-natural, or derivatized nucleotide bases. The backbone of the polynucleotide can comprise sugars and phosphate groups, as may typically be found in RNA or DNA, or modified or substituted sugar or phosphate groups. A polynucleotide may comprise modified nucleotides, such as methylated nucleotides and nucleotide analogs. The sequence of nucleotides may be interrupted by non-nucleotide components. Thus, the terms nucleoside, nucleotide, deoxynucleoside and deoxynucleotide generally include analogs such as those described herein. These analogs can be those molecules having some structural features in common with a naturally occurring nucleoside or nucleotide such that when incorporated into a nucleic acid or oligonucleotide sequence, they allow hybridization with a naturally occurring nucleic acid sequence in solution. Typically, these analogs can be derived from naturally occurring nucleosides and nucleotides by replacing and/or modifying the base, the ribose or the phosphodiester moiety. The changes can be tailor made to stabilize or destabilize hybrid formation or enhance the specificity of hybridization with a complementary nucleic acid sequence as desired.

The term "complementary" as used herein can refer to the hybridization or base pairing between nucleotides or nucleic acids, such as, for instance, between the two strands of a double stranded DNA molecule or between an oligonucleotide primer and a primer binding site on a single stranded nucleic acid to be sequenced or amplified. See, M. Kanehisa Nucleic Acids Res. 12:203 (1984), incorporated herein by reference.

An analyte assay can be a detection or diagnostic method as provided herein. In some cases, the sample can comprise or contain the analyte. The analyte can be derived, removed or extracted from a cell or cells within the sample. The analyte can be a protein or a nucleic acid. The analyte can be a cell-free or extracellular nucleic acid. In some cases, the analyte is a circulating tumor nucleic acid. The nucleic acid can be such DNA or RNA. In some cases, the nucleic acid is cell-free DNA (cfDNA). The cfDNA can be circulating tumor DNA (ctDNA).

The term "sample" as used herein can refer to a biological sample, such as a liquid biological sample or bodily fluid or a biological tissue. Examples of liquid biological samples or bodily fluids for use in the methods provided herein can include urine, blood, plasma, serum, saliva, ejaculate, stool, sputum, cerebrospinal fluid (CSF), tears, mucus, amniotic fluid or the like. Biological tissues as used herein can be aggregates of cells, usually of a particular kind together with their intercellular substance that form one of the structural materials of a human, animal, plant, bacterial, fungal or viral structure, including connective, epithelium, muscle and nerve tissues. Examples of biological tissues also include organs, tumors, lymph nodes, arteries and individual cell(s). A biological tissue sample can be a biopsy. In one embodiment, the sample is a biopsy of a tumor, which can be referred to as a tumor sample. In one embodiment, the analyses described herein are performed on biopsies that are freshly obtained or derived. In one embodiment, the analyses described herein are performed on biopsies that are frozen. In one embodiment, the analyses described herein are performed on biopsies that are embedded in paraffin wax. Accordingly, the methods provided herein, including the RT-PCR methods, are sensitive, precise and have multianalyte capability for use with paraffin embedded samples. See, for example, Cronin et al. (2004) Am. J Pathol. 164 (1):35-42, herein incorporated by reference.

Formalin fixation and tissue embedding in paraffin wax is a universal approach for tissue processing prior to light microscopic evaluation. A major advantage afforded by formalin-fixed paraffin-embedded (FFPE) specimens is the preservation of cellular and architectural morphologic detail in tissue sections. (Fox et al. (1985) J Histochem Cytochem 33:845-853). The standard buffered formalin fixative in which biopsy specimens are processed is typically an aqueous solution containing 37% formaldehyde and 10-15% methyl alcohol. Formaldehyde is a highly reactive dipolar compound that results in the formation of protein-nucleic acid and protein-protein crosslinks in vitro (Clark et al. (1986) J Histochem Cytochem 34:1509-1512; McGhee and von Hippel (1975) Biochemistry 14:1281-1296, each incorporated by reference herein).

In one embodiment, the sample used herein is obtained from an individual, and comprises fresh-frozen paraffin embedded (FFPE) tissue.

The term "tumor," as used herein, can refer to all neoplastic cell growth and proliferation, whether malignant or benign, and all pre-cancerous and cancerous cells and tissues. The terms "cancer," "cancerous," and "tumor" are not mutually exclusive and can be used interchangeably.

The term "detection" can include any means of detecting, including direct and indirect detection.

A sample as provided herein can be processed to render it competent for fragmentation, ligation, denaturation, and/or amplification. Exemplary sample processing can include lysing cells of the sample to release nucleic acid, purifying the sample (e.g., to isolate nucleic acid from other sample components, which can inhibit enzymatic reactions), diluting/concentrating the sample, and/or combining the sample with reagents for further nucleic acid processing such as nucleic acid extension, amplification and/or sequencing. In some examples, the sample can be combined with a restriction enzyme, reverse transcriptase, or any other enzyme of nucleic acid processing.

The term "biomarkers" or "classifier biomarkers" or "classifier" can include nucleic acids (e.g., genes) and proteins, and variants and fragments thereof. Such biomarkers can include RNA or DNA, including cDNA, comprising the entire or partial sequence of the nucleic acid sequence encoding the biomarker, or the complement of such a sequence. The biomarker nucleic acids can also include any expression product or portion thereof of the nucleic acid sequences of interest. A biomarker protein is a protein encoded by or corresponding to a DNA or RNA biomarker of the invention. A biomarker protein comprises the entire or partial amino acid sequence of any of the biomarker proteins or polypeptides. The biomarker nucleic acid can be extracted from a cell or can be cell free or extracted from an extracellular vesicular entity such as an exosome or microvesicle.

A "biomarker" or "classifier biomarker" or "classifier" can be any nucleic acid (e.g., gene) or protein whose level of expression in a tissue or cell is altered compared to that of a normal or healthy cell or tissue. The detection, and in some cases the level, of the biomarkers can permit the differentiation of samples. The "classifier biomarker" or "biomarker" or "classifier" may be one that is up-regulated (e.g. expression is increased) or down-regulated (e.g. expression is decreased) relative to a reference or control as provided herein. The overall expression level of each gene tested from a sample can be referred to herein as the "'expression profile" and can be used to classify a training set or a test sample as provided herein. However, it is understood that independent evaluation of expression for each of the genes disclosed herein can be used to classify a training set or a test sample (e.g., as being an anti-FGFR3 agent or FGFR3 inhibitor responsive group or not) without the need to group up-regulated and down-regulated genes into one or more gene cassettes. In some cases, as shown in Table 1, a total of 130 biomarkers can be used for assessment of an FGFR3 inhibitor predictive response. In some cases, as shown in Table 2, a total of 80 biomarkers can be used for assessment of an FGFR3 inhibitor predictive response. In some cases, as shown in Table 3, a total of 112 gene pairs can be used for assessment of an FGFR3 inhibitor predictive response. In some cases, as shown in Table 4, a total of 73 gene pairs can be used for assessment of an FGFR3 inhibitor predictive response.

As used herein, an "expression profile" or a "biomarker profile" or "gene signature" comprises one or more values corresponding to a measurement of the relative abundance, level, presence, or absence of expression of a discriminative or classifier gene or biomarker. An expression profile can be derived from a subject prior to or subsequent to a diagnosis of a cancer, can be derived from a biological sample collected from a subject at one or more time points prior to or following treatment or therapy, can be derived from a biological sample collected from a subject at one or more time points during which there is no treatment or therapy, or can be collected from a healthy subject. The subject can be a human patient. The one or more biomarkers of the biomarker profiles provided herein are selected from one or more biomarkers of Table 1 or Table 2. The one or more biomarkers of the biomarker profiles provided herein are selected from one or more gene pairs of Table 3 or Table 4.

As used herein, the term “oncogene” can refer to a gene that is a mutated (changed or altered) form of a gene that causes the transformation of normal cells into cancerous tumor cells and/or a gene whose aberrant expression or activation at an abnormal point in development for expression or activation of said gene causes the transformation of normal cells into cancerous tumor cells. Oncogenes may cause the growth of cancer cells. Mutations in genes that become oncogenes can be inherited or caused by being exposed to substances in the environment that cause cancer. Oncogenes can also be viral genes that transform a host cell into a tumor cell. An “oncogenic mutation” can refer to a mutation in a gene that causes the transformation of a host cell into a cancerous tumor cell. A mutation as referred to herein should be construed broadly, and include single nucleotide polymorphisms (SNPs), sequence insertions, deletions, inversions, gene amplifications and other sequence replacements. As used herein, the term “non-synonymous” or non-synonymous SNPs” refers to mutations that lead to coding changes in host cell proteins.

As used herein, the term “FGFR mutation” or “FGFR mutations” can refer to any mutation known in the art in an fgfr gene and/or the protein encoded thereby. Likewise, the term “FGFR3 mutation” or “FGFR3 mutations” can refer to any mutation known in the art in an fgfr3 gene and/or the protein encoded thereby.

As used herein, the term “determining an expression level” or “determining an expression profile” or “detecting an expression level” or “detecting an expression profile” as used in reference to a biomarker or classifier means the application of a biomarker specific reagent such as a probe, primer or antibody and/or a method to a sample, for example a sample of the subject or patient and/or a control sample, for ascertaining or measuring quantitatively, semi-quantitatively or qualitatively the amount of a biomarker or biomarkers, for example the amount of biomarker polypeptide or mRNA (or cDNA derived therefrom). For example, a level of a biomarker can be determined by a number of methods including for example immunoassays including, for example, immunohistochemistry, ELISA, Western blot, immunoprecipitation and the like, where a biomarker detection agent such as an antibody for example, a labeled antibody, specifically binds the biomarker and permits for example relative or absolute ascertaining of the amount of polypeptide biomarker, hybridization and PCR protocols where a probe or primer or primer set are used to ascertain the amount of nucleic acid biomarker, including for example probe based and amplification based methods including for example microarray analysis, RT-PCR such as quantitative RT-PCR (qRT-PCR), serial analysis of gene expression (SAGE), Northern Blot, digital molecular barcoding technology, for example Nanostring Counter Analysis, and TaqMan quantitative PCR assays. Other methods of mRNA detection and quantification can be applied, such as mRNA in situ hybridization in formalin-fixed, paraffin-embedded (FFPE) tissue samples or cells. This technology is currently offered by the QuantiGene ViewRNA (Affymetrix), which uses probe sets for each mRNA that bind specifically to an amplification system to amplify the hybridization signals; these amplified signals can be visualized using a standard fluorescence microscope or imaging system. This system for example can detect and measure transcript levels in heterogeneous samples; for example, if a sample has normal and tumor cells present in the same tissue section. As mentioned, TaqMan probe-based gene expression analysis (PCR-based) can also be used for measuring gene expression levels in tissue samples, and this technology has been shown to be useful for measuring mRNA levels in FFPE samples. In brief, TaqMan probe-based assays utilize a probe that hybridizes specifically to the mRNA target. This probe contains a quencher dye and a reporter dye (fluorescent molecule) attached to each end, and fluorescence is emitted only when specific hybridization to the mRNA target occurs. During the amplification step, the exonuclease activity of the polymerase enzyme causes the quencher and the reporter dyes to be detached from the probe, and fluorescence emission can occur. This fluorescence emission is recorded and signals are measured by a detection system; these signal intensities are used to calculate the abundance of a given transcript (gene expression) in a sample.

The present invention also encompasses a system capable of distinguishing various subtypes of cancer that may or may not be amendable to treatment with an anti-FGFR agent or anti-FGFR3 agent in a sample obtained from a subject suspected of suffering from cancer. This system can be capable of processing a large number of subjects and subject variables such as expression profiles and other diagnostic criteria. The methods and systems incorporating said methods described herein can be used for “pharmacometabonomics,” in analogy to pharmacogenomics, e.g., predictive of response to therapy. In this embodiment, subjects could be divided into “responders” and “nonresponders” using the expression profile as evidence of “response,” and features of the expression profile could then be used to target future subjects who would likely respond to a particular therapeutic course.

The expression profile can be used in combination with other diagnostic methods including histochemical, immunohistochemical, cytologic, immunocytologic, and visual diagnostic methods including histologic or morphometric evaluation of samples (e.g., tissue samples).

In various embodiments of the present invention, the expression profile or signature derived from a subject is compared to a reference expression profile or signature. A “reference expression profile” can be a profile derived from the subject prior to treatment or therapy; can be a profile produced from the subject’s sample at a particular time point (usually prior to or following treatment or therapy, but can also include a particular time point prior to or following diagnosis of a type of cancer); or can be derived from a healthy individual or a pooled reference from healthy individuals. A reference expression profile can be specific to cancer types or subtypes known to be responders to FGFR inhibitor therapy or FGFR3 inhibitor therapy or non-responders to FGFR inhibitor therapy or FGFR3 inhibitor therapy. A reference expression profile can be specific to cancer types or subtypes known to be proliferative or non-proliferative.

The reference expression profile or signature can be compared to a test expression profile or signature. A “test expression profile” can be derived from the same subject as the reference expression profile except at a subsequent time point (e.g., one or more days, weeks or months following collection of the reference expression profile) or can be derived from a different subject. In summary, any test expression profile of a subject can be compared to a previously collected profile from a subject whose cancer type or subtype is known to be responsive to FGFR inhibitor therapy or FGFR3 inhibitor therapy or non-responsive to FGFR inhibitor therapy or FGFR3 inhibitor therapy.

Overview

The present invention provides methods, compositions or kits that can be used to provide an assessment or determination of a fibroblast growth factor receptor-3 (FGFR-3) mutational or alteration status (also referred to as an FGFR3 activation signature or FAS) of a sample obtained from a subject suffering from or suspected of suffering from a cancer. In one embodiment, the assessment or determination of the FGFR-3 mutational status comprises measuring an expression level of a defined set of biomarkers in the sample obtained from the subject. The measurement of the expression level can be at the nucleic acid or protein level or any combination thereof. The measurement of the expression level can be performed using of any of the methods provided herein for measuring expression levels at the nucleic acid or protein level. In one embodiment, the FGFR-3 mutational status is used to determine the likelihood of the subject suffering from or suspected of suffering from a cancer being responsive to treatment with a therapeutic agent or a defined set of therapeutic agents. In another embodiment, the FGFR-3 mutational status of the sample obtained from the subject is predictive of said subject being responsive or non-responsive to a defined set of therapeutic agents. In yet another embodiment, the FGFR-3 mutational status of the sample obtained from the subject is used in a method to treat the cancer that the subject is suffering from or suspected of suffering from such that a defined set of therapeutic agents is administered to the subject based on the FGFR-3 mutational status determined for the sample. The sample can be any type of sample provided herein such as, for example, a tumor sample or biopsy. The cancer can be any cancer known in the art and/or provided herein. The defined set of therapeutic agents can be any agent known in the art and/or provided herein that exhibits inhibitory activity toward a fibroblast growth factor receptor (FGFR) generally and/or a fibroblast growth factor receptor-3 (FGFR3), specifically. In one embodiment, the measuring of the expression level of the defined set of biomarkers generates or produces an expression profile that represents the fibroblast growth factor receptor-3 (FGFR-3) activation signature (FAS) of the sample. In this way, a set of biomarkers as provided herein (e.g., Tables 1-4) can each be referred to as an FGFR3 activation signature (FAS) or FGFR3 activation classifier. As alluded to herein, the FAS can reflect or represent a presence or absence of one or more FGFR3 mutation(s) or alteration(s) in the sample obtained from the subject. Samples whose FAS indicates that the subject possesses an FGFR3 alteration or mutation is said to have a positive FAS or be FAS (+). Conversely, samples whose FAS indicates that the subject does not possess an FGFR3 alteration or mutation is said to have a negative FAS or be FAS (−). Whether or not an FAS of a sample is positive or negative can be determined by comparing the FAS determined for the sample to the FAS for one or more reference or control samples. In one embodiment, the reference or control sample is a sample known to possess one or more mutations and/or fusions in the fgfr3 gene. In one embodiment, the reference or control sample is a sample known to not possess or harbor one or more mutations and/or fusions in the fgfr3 gene. In one embodiment, the FAS of the sample obtained from the subject is compared to the FAS of a sample known to possess one or more mutations and/or fusions in the fgfr3 gene. In another embodiment, the FAS of the sample obtained from the subject is compared to the FAS of a sample known to not possess one or more mutations and/or fusions in the fgfr3 gene. In yet another embodiment, the FAS of the sample obtained from the subject is compared to the FAS of a sample known to possess one or more mutations and/or fusions in the fgfr3 gene and the FAS of a sample known to not possess one or more mutations and/or fusions in the fgfr3 gene. The one or more alterations or mutations in the fgfr3 gene can be any mutation and/or fusion in the fgfr3 gene known in the art. In one embodiment, the one or more alterations or mutations in the fgfr3 gene are selected from those mutations that encode an FGFR3 protein with a S249C, R248C, Y373C, R248C, S249C, G370C, G372C, Y373C or Y375C mutation. In one embodiment, the one or more alterations or mutations in the fgfr3 gene can be selected from a fusion of the fgfr3-tacc3 genes that encode an FGFR3-TACC3 fusion protein and a fusion of the fgfr3-baiap2l1 genes that encode an FGFR3-BAIAP2L1 fusion protein.

In one embodiment, a positive FAS of a sample obtained from a subject suffering from or suspected of suffering from a cancer indicates that the subject may be responsive to a therapeutic agent or defined set of therapeutic agents that exhibit(s) inhibitory activity toward a fibroblast growth factor receptor (FGFR) generally and/or a fibroblast growth factor receptor-3 (FGFR3), specifically. The therapeutic agent or defined set of therapeutic agents that exhibit(s) inhibitory activity toward a fibroblast growth factor receptor (FGFR) generally and/or a fibroblast growth factor receptor-3 (FGFR3), specifically can be administered to the subject in a therapeutically effective dose or doses alone or in combination with one or more additional therapeutic agents or modalities as described herein. In one embodiment, a negative FAS of a sample obtained from a subject suffering from or suspected of suffering from a cancer indicates that the subject may be responsive to a therapeutic agent or defined set of therapeutic agents other than those that exhibit(s) inhibitory activity toward a fibroblast growth factor receptor (FGFR) generally and/or a fibroblast growth factor receptor-3 (FGFR3), specifically such as one or more therapeutic agents or modalities known in the art and/or as described herein. The therapeutic agent that exhibit(s) inhibitory activity toward a fibroblast growth factor receptor (FGFR) generally and/or a fibroblast growth factor receptor-3 (FGFR3), specifically can be a tyrosine kinase inhibitor, an antibody, an antibody-conjugate or any combination thereof.

In one embodiment, the set of biomarkers for use in the compositions, methods and kits provided herein in order to determine an FGFR3 activation signature (FAS) of a sample obtained from a subject is selected from the biomarkers listed in Table 1 or Table 2. The set of biomarkers can comprise one or a plurality of biomarkers selected from Table 1 or Table 2. The set of biomarkers can comprise one or a plurality of biomarkers selected from Table 1 and Table 2. In some cases, the plurality of biomarker comprises, consists essentially of or consists of exactly, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128 or 129 biomarkers of Table 1. In some cases, the plurality of biomarker comprises, consists essentially of or consists of all the biomarkers of Table 1. In some cases, the plurality of biomarker consists of only the biomarkers of Table 1. In some cases, the plurality of biomarker comprises, consists essentially of or consists of exactly, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, or 79 biomarkers of Table 2. In some cases, the plurality of biomarker comprises, consists essentially of or consists of all the biomarkers of Table 2. In some cases, the plurality of biomarker consists of only the biomarkers of Table 2. The detection can be by using any amplification, hybridization and/or sequencing assay disclosed herein. In some cases, the plurality of biomarker comprises, consists essentially of or consists of a subset of biomarkers of Table 1 and Table 2. In some cases, the plurality of biomarker comprises, consists essentially of or consists of all the biomarkers of Table 1 and Table 2. In some cases, the plurality of biomarker consists of only the biomarkers of Table 1 and Table 2.

The set of biomarkers for use in the compositions, methods and kits provided herein in order to determine an FGFR3 activation signature (FAS) of a sample obtained from a subject can be a set of biomarker gene pairs. In one embodiment, the set of biomarker gene pairs is selected from the biomarker gene pairs listed in Table 3 or Table 4. In one embodiment, the set of biomarker gene pairs is selected from Table 3 and Table 4. Each gene pair in the set of biomarker gene pairs can comprise a gene A and a gene B. Each gene pair selected from Table 3 comprises of a gene A and a gene B as recited in Table 3. Each gene pair selected from Table 4 comprises of a gene A and a gene B as recited in Table 4. The set of biomarker gene pairs can comprise one or a plurality of biomarker gene pairs selected from Table 3 or Table 4. In some cases, the plurality of biomarker gene pairs comprises, consists essentially of or consists of only, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110 or 111 biomarker gene pairs of Table 3. In some cases, the plurality of biomarker gene pairs comprises, consists essentially of or consists of all the biomarker gene pairs of Table 3. In some cases, the plurality of biomarker gene pairs consists of only the biomarker gene pairs of Table 3. In some cases, the plurality of biomarker gene pairs comprises, consists essentially of or consists of only, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 biomarker gene pairs of Table 4. In some cases, the plurality of biomarker gene pairs comprises, consists essentially of or consists of all the biomarker gene pairs of Table 4. In some cases, the plurality of biomarker gene pairs consists of only the biomarker gene pairs of Table 4. In some cases, the plurality of biomarker comprises, consists essentially of or consists of a subset of biomarkers of Table 3 and Table 4. In some cases, the plurality of biomarker gene pairs comprises, consists essentially of or consists of all the biomarkers of Table 3 and Table 4. In some cases, the plurality of biomarker gene pairs consists of only the biomarkers of Table 3 and Table 4.

In one embodiment, assessment or determination of the FGFR3 alteration or mutational status of a sample obtained from a subject suffering from or suspected of suffering from a cancer comprises determining an expression profile of two or more sets of biomarkers. The two or more sets of biomarkers can be selected from the set of biomarkers of Table 1 and Table 2, and the set of biomarker gene pairs of Table 3 and Table 4 and any combination thereof.

The expression level of any and all genes utilized in an FAS or combination of FASs as provided herein can be normalized as provided herein, such as, for example, normalizing expression of the classifier genes or classifier gene pairs by using expression levels from one or more reference or housekeeping genes. The housekeeping genes can be any housekeeping genes known in the art and/or provided herein such as, for example, GAPDH and/or beta-actin.

Measuring Biomarkers Expression Levels

In one embodiment, the detecting, determining or measuring the expression level of any biomarker, including each member of a biomarker pair, in any sample in any of the methods provided herein is performed at the nucleic acid level. The nucleic acid can be DNA, cDNA or RNA. Measuring the nucleic acid level can be performed by any suitable technique including, but not limited to, RNA-seq, a reverse transcriptase polymerase chain reaction (RT-PCR), a microarray hybridization assay, or another hybridization assay, e.g., a NanoString assay for example, with primers and/or probes specific to the classifier biomarkers, and/or the like. In some cases, the primers useful for the amplification methods (e.g., RT-PCR or qRT-PCR) are any forward and reverse primers suitable for binding to a classifier gene provided herein, such as the classifier biomarkers listed in Tables 1-4.

In one embodiment, the measuring or detecting step for methods provided herein that comprise determining an FGFR3 activation signature (FAS) of a sample obtained from a subject suffering from or suspected of suffering from a cancer as provided herein is at the nucleic acid level. The measuring or detecting step can entail performing RNA-seq, a reverse transcriptase polymerase chain reaction (RT-PCR) or a hybridization assay with oligonucleotides that are substantially complementary to portions of cDNA molecules of the at least one or plurality of classifier biomarker(s) of Table 1 or Table 2 under conditions suitable for RNA-seq, RT-PCR or hybridization and obtaining expression levels of the at least one or plurality of classifier biomarkers based on the detecting step. In one embodiment, the measuring or detecting step for methods of determining an FAS as provided herein comprises mixing the sample with one or more oligonucleotides that are complementary or substantially complementary to portions of cDNA molecules of the at least one or plurality of classifier biomarkers of Table 1 or Table 2 under conditions suitable for hybridization of the one or more oligonucleotides to their complements or substantial complements; detecting whether hybridization occurs between the one or more oligonucleotides to their complements or substantial complements; and obtaining hybridization values of the at least one or plurality of classifier biomarkers based on the detecting step such that the hybridization values represent expression levels. In one embodiment, the measuring or detecting step for methods of determining an FAS as provided herein comprises mixing the sample with oligonucleotides that are complementary or substantially complementary to portions of DNA (e.g., cDNA) molecules of the at least one or plurality of classifier biomarkers of Table 1 or Table 2 under conditions suitable for hybridization of the oligonucleotides to their complements or substantial complements and subsequent amplification of said DNA (e.g. cDNA); detecting whether amplification occurred between the oligonucleotides and their complements or substantial complements; and obtaining expression levels of the amplicons of the at least one or plurality of classifier biomarkers based on the detecting step.

In one embodiment, the expression levels of the at least one or plurality of the classifier biomarkers of the sample obtained from the subject suffering from or suspected of suffering from a cancer are then compared to reference expression levels of the at least one or plurality of the classifier biomarkers of Table 1 or Table 2 from at least one sample training set. The at least one sample training set can comprise, (i) expression levels from an FAS (+) sample and/or (ii) expression levels from an FAS (−) sample. The sample can then be classified as an FAS (+) or FAS (−) subtype or sample based on the results of the comparing step.

In one embodiment, the comparing step can comprise applying a statistical algorithm which comprises determining a correlation between the expression data obtained by measuring one or a plurality of biomarkers from Table 1 or Table 2 on the sample obtained from the subject and the expression data from the at least one training set(s); and classifying the sample as an FAS (+) or FAS (−) subtype or sample based on the results of the statistical algorithm. The statistical algorithm can entail finding the centroid to which the FAS of the sample obtained from the subject is nearest from the centroids constructed from the expression data from the at least one training set, using any distance measure e.g. Euclidean distance or correlation. The centroids can be constructed using any method known in the art for generating centroids such as, for example, those found in Mullins et al. (2007) Clin Chem. 53(7):1273-9 or Dabney (2005) Bioinformatics 21(22):4148-4154 The FAS of the sample obtained from subject can then be assigned based on the use of a classification to the nearest centroid (CLaNC) algorithm as applied to the expression data generated from the sample obtained from the subject and the centroid(s) constructed for the at least one training set. The CLaNC algorithm for use in the methods, compositions and kits provided herein can be the CLaNC algorithm implemented by the CLaNC software found in Dabney AR. ClaNC: Point-and-click software for classifying microarrays to nearest centroids. Bioinformatics. 2006; 22: 122-123, which is herein incorporated by reference in its entirety or equivalents or derivatives thereof.

In one embodiment, the measuring or detecting step for methods provided herein that comprise determining an FGFR3 activation signature (FAS) of a sample obtained from a subject suffering from or suspected of suffering from a cancer as provided herein is at the nucleic acid level. The measuring or detecting step can entail performing RNA-seq, a reverse transcriptase polymerase chain reaction (RT-PCR) or a hybridization assay with oligonucleotides that are substantially complementary to portions of cDNA molecules of each member of at least one gene pair or plurality of classifier biomarker gene pairs of Table 3 or Table 4 under conditions suitable for RNA-seq, RT-PCR or hybridization and obtaining expression levels of each member of the at least one gene pair or plurality of classifier biomarker gene pairs based on the detecting step. In one embodiment, the measuring or detecting step for methods of determining an FAS as provided herein comprises mixing the sample with one or more oligonucleotides that are complementary or substantially complementary to portions of cDNA molecules for each member (i.e., gene A and gene B) of the at least one gene pair or plurality of classifier biomarker gene pairs of Table 3 or Table 4 under conditions suitable for hybridization of the one or more oligonucleotides to their complements or substantial complements; detecting whether hybridization occurs between the one or more oligonucleotides to their complements or substantial complements; and obtaining hybridization values of each member (i.e., gene A and gene B) of the at least one gene pair or plurality of classifier biomarker gene pairs based on the detecting step such that the hybridization values represent expression levels. In one embodiment, the measuring or detecting step for methods of determining an FAS as provided herein comprises mixing the sample with oligonucleotides that are complementary or substantially complementary to portions of DNA (e.g., cDNA) molecules of each member (i.e., gene A and gene B) of the at least one gene pair or plurality of classifier biomarker gene pairs of Table 3 or Table 4 under conditions suitable for hybridization of the oligonucleotides to their complements or substantial complements and subsequent amplification of said DNA (e.g. cDNA); detecting whether amplification occurred between the oligonucleotides and their complements or substantial complements; and obtaining expression levels of the amplicons of each member of the at least one gene pair or plurality of classifier biomarker gene pairs based on the detecting step.

In embodiments utilizing one or more classifier biomarker gene pairs from Table 3, the FAS of the sample can be determined following the detecting step by determining a score for the sample using the expression level of gene A and gene B for each classifier biomarker gene pair whose expression level was determined and the intercept from Table 3. More specifically, for each gene pair from the one or the plurality of biomarker gene pairs selected from Table 3 where the detected expression level of gene A is greater than the detected expression level of gene B, the coefficient for that gene pair from Table 3 was input into EQUATION 1 along with the classifier model intercept from Table 3. The sum of all such coefficients and the intercept from Table 3 represents the score of the sample. In one embodiment, the higher the score, the more positive the FGFR activation signature is designated to be or the more activated the sample is deemed to be. In some cases, a score greater than a cut-off point such as, for example, zero, would designate the FAS as being positive and if the score is lower than or equal to the cut-off point, then the FAS would be designated as being negative.

In embodiments utilizing one or more classifier biomarker gene pairs from Table 4, the FAS of the sample can be determined following the detecting step by determining a score for the sample using the expression level of gene A and gene B for each classifier biomarker gene pair whose expression level was determined and the intercept from Table 4. More specifically, for each gene pair from the one or the plurality of biomarker gene pairs selected from Table 4 where the detected expression level of gene A is greater than the detected expression level of gene B, the coefficient for that gene pair from Table 4 was input into EQUATION 1 along with the classifier model intercept from Table 4. The sum of all such coefficients and the intercept from Table 4 represents the score of the sample. In one embodiment, the higher the score, the more positive the FGFR activation signature is designated to be or the more activated the sample is deemed to be. In some cases, a score greater than a cut-off point such as, for example, zero, would designate the FAS as being positive and if the score is lower than or equal to the cut-off point, then the FAS would be designated as being negative.

$A_i$ and $B_i$ are the measured expression of Genes A and B of gene pair from Table 3 or Table 4 in the $i^{th}$ row, $C_i$ is the $i^{th}$ coefficient, and I is the intercept, then a score was calculated as follows:

$$d = I + \sum_i P_i C_i \qquad \text{EQUATION 1}$$

In some cases, EQUATION 1 can be modified (see EQUATION 2) in order to classify the sample as being FAS(+) or FAS(−) based on the detected expression levels of gene A and gene B from each classifier biomarker gene pair from Table 3 or Table 4 whose expression was measured. More specifically, to classify the sample, gene expression from pairs of genes in Table 3 or Table 4 can be compared such that for each gene pair, if gene A expression is greater than gene B expression, the coefficient for that gene pair from Table 3 or Table 4 can be added to a running sum. If the sum of all such coefficients and the intercept from Table 3 or Table 4 is greater than zero, the sample is classified as being FAS (+) or, in other words, possessing one or more mutations in an fgfr3 gene (see EQUATION 2). The one or more alterations or mutations in the fgfr3 gene can be any mutation and/or fusion in the fgfr3 gene known in the art. In one embodiment, the one or more alterations or mutations in the fgfr3 gene are selected from those mutations that encode an FGFR3 protein with a S249C, R248C, Y373C, R248C, S249C, G370C, G372C, Y373C or Y375C mutation. In one embodiment, the one or more alterations or mutations in the fgfr3 gene can be selected from a fusion of the fgfr3-tacc3 genes that encode an FGFR3-TACC3 fusion protein and a fusion of the fgfr3-baiap2l1 genes that encode an FGFR3-BAIAP2L1 fusion protein.

Using the gene pairs in Table 3 or Table 4, if $A_i$ and $B_i$ are the measured expression of Genes A and B of a gene pair from Table 3 or Table 4 in the $i^{th}$ row, $C_i$ is the $i^{th}$ coefficient, and I is the intercept, then a decision can be calculated as follows:

$$P_i = \begin{cases} 1 \text{ if } A_i > B_i \\ 0 \text{ if } B_i \geq A_i \end{cases} \qquad \text{EQUATION 2}$$

$$d = I + \sum_i P_i C_i$$

$$\text{decision} = \begin{cases} FAS(+) \text{ if } d > \text{cut-off point (e.g., 0)} \\ FAS(-) \text{ if } d \leq \text{cut-off point (e.g., 0)} \end{cases}$$

The biomarkers described herein can include RNA comprising the entire or partial sequence of any of the nucleic acid sequences of interest, or their non-natural cDNA product, obtained synthetically in vitro in a reverse transcription reaction. The term "fragment" is intended to refer to a portion of the polynucleotide that generally comprise at least 10, 15, 20, 50, 75, 100, 150, 200, 250, 300, 350, 400, 450, 500, 550, 600, 650, 700, 800, 900, 1,000, 1,200, or 1,500 contiguous nucleotides, or up to the number of nucleotides present in a full-length biomarker polynucleotide disclosed herein. A fragment of a biomarker polynucleotide will generally encode at least 15, 25, 30, 50, 100, 150, 200, or 250 contiguous amino acids, or up to the total number of amino acids present in a full-length biomarker protein of the invention.

In some embodiments, overexpression, such as of an RNA transcript or its expression product, is determined by normalization to the level of reference RNA transcripts or their expression products, which can be all measured transcripts (or their products) in the sample or a particular reference set of RNA transcripts (or their non-natural cDNA products). Normalization is performed to correct for or normalize away both differences in the amount of RNA or cDNA assayed and variability in the quality of the RNA or cDNA used. Therefore, an assay typically measures and incorporates the expression of certain normalizing genes, including well known housekeeping genes, such as, for example, GAPDH and/or β-Actin. Alternatively, normalization can be based on the mean or median signal of all of the assayed biomarkers or a large subset thereof (global normalization approach).

Isolated mRNA from samples obtained from a patient or subject can be used in the methods, compositions and kits provided herein. As necessitated, the isolated mRNA can be used in hybridization or amplification assays that include, but are not limited to, Southern or Northern analyses, PCR analyses and probe arrays, NanoString Assays. One method for the detection of mRNA levels involves contacting the isolated mRNA or synthesized cDNA with a nucleic acid molecule (probe) that can hybridize to the mRNA encoded by the gene being detected. The nucleic acid probe can be, for example, a cDNA, or a portion thereof, such as an oligonucleotide of at least 7, 15, 30, 50, 100, 250, or 500 nucleotides in length and sufficient to specifically hybridize under stringent conditions to the non-natural cDNA or mRNA biomarker of the present invention.

As explained above, in one embodiment, once the mRNA is obtained from a sample, it is converted to complementary DNA (cDNA) in a hybridization reaction. Conversion of the mRNA to cDNA can be performed with oligonucleotides or primers comprising sequence that is complementary to a portion of a specific mRNA. Conversion of the mRNA to cDNA can be performed with oligonucleotides or primers comprising random sequence. Conversion of the mRNA to cDNA can be performed with oligonucleotides or primers comprising sequence that is complementary to the poly(A) tail of an mRNA. cDNA does not exist in vivo and therefore is a non-natural molecule. In a further embodiment, the cDNA is then amplified, for example, by the polymerase chain reaction (PCR) or other amplification method known to those of ordinary skill in the art. PCR can be performed with the forward and/or reverse primers comprising sequence complementary to at least a portion of a classifier gene provided herein, such as the classifier biomarkers in Tables 1-4. The product of this amplification reaction, i.e., amplified cDNA is necessarily a non-natural product. As mentioned above, cDNA is a non-natural molecule. Second, in the case of PCR, the amplification process serves to create hundreds of millions of cDNA copies for every individual cDNA molecule of starting material. The number of copies generated is far removed from the number of copies of mRNA that are present in vivo.

In one embodiment, cDNA is amplified with primers that introduce an additional DNA sequence (adapter sequence) onto the fragments (with the use of adapter-specific primers). The adaptor sequence can be a tail, wherein the tail sequence is not complementary to the cDNA. For example, the forward and/or reverse primers comprising sequence complementary to at least a portion of a classifier gene provided herein, such as the classifier biomarkers from Table 1-4 can comprise tail sequence. Amplification therefore serves to create non-natural double stranded molecules from the non-natural single stranded cDNA, by introducing barcode, adapter and/or reporter sequences onto the already non-natural cDNA. In one embodiment, during amplification with the adapter-specific primers, a detectable label, e.g., a fluorophore, is added to single strand cDNA molecules. Amplification therefore also serves to create DNA complexes that do not occur in nature, at least because (i) cDNA does not exist in vivo, (ii) adapter sequences are added to the ends of cDNA molecules to make DNA sequences that do not exist in vivo, (iii) the error rate associated with amplification further creates DNA sequences that do not exist in vivo, (iv) the disparate structure of the cDNA molecules as compared to what exists in nature, and (v) the chemical addition of a detectable label to the cDNA molecules.

In one embodiment, the synthesized cDNA (for example, amplified cDNA) is immobilized on a solid surface via hybridization with a probe, e.g., via a microarray. In another embodiment, cDNA products are detected via real-time polymerase chain reaction (PCR) via the introduction of fluorescent probes that hybridize with the cDNA products. For example, in one embodiment, biomarker detection is assessed by quantitative fluorogenic RT-PCR (e.g., with TaqMan® probes). For PCR analysis, well known methods are available in the art for the determination of primer sequences for use in the analysis.

Biomarkers provided herein in one embodiment, are detected via a hybridization reaction that employs a capture probe and/or a reporter probe. For example, the hybridization probe is a probe derivatized to a solid surface such as a bead, glass or silicon substrate. In another embodiment, the capture probe is present in solution and mixed with the patient's sample, followed by attachment of the hybridization product to a surface, e.g., via a biotin-avidin interaction (e.g., where biotin is a part of the capture probe and avidin is on the surface). The hybridization assay, in one embodiment, employs both a capture probe and a reporter probe. The reporter probe can hybridize to either the capture probe or the biomarker nucleic acid. Reporter probes e.g., are then counted and detected to determine the level of biomarker(s) in the sample. The capture and/or reporter probe, in one embodiment contain a detectable label, and/or a group that allows functionalization to a surface.

For example, the nCounter gene analysis system (see, e.g., Geiss et al. (2008) Nat. Biotechnol. 26, pp. 317-325, incorporated by reference in its entirety for all purposes, is amenable for use with the methods provided herein.

Hybridization assays described in U.S. Pat. Nos. 7,473,767 and 8,492,094, the disclosures of which are incorporated by reference in their entireties for all purposes, are amenable for use with the methods provided herein, i.e., to detect the biomarkers and biomarker combinations described herein.

Biomarker levels may be monitored using a membrane blot (such as used in hybridization analysis such as Northern, Southern, dot, and the like), or microwells, sample tubes, gels, beads, or fibers (or any solid support comprising bound nucleic acids). See, for example, U.S. Pat. Nos. 5,770,722, 5,874,219, 5,744,305, 5,677,195 and 5,445,934, each incorporated by reference in their entireties.

In one embodiment, microarrays are used to detect biomarker levels. Microarrays are particularly well suited for this purpose because of the reproducibility between different experiments. DNA microarrays provide one method for the simultaneous measurement of the expression levels of large numbers of genes. Each array consists of a reproducible pattern of capture probes attached to a solid support. Labeled RNA or DNA is hybridized to complementary probes on the array and then detected by laser scanning hybridization intensities for each probe on the array are determined and converted to a quantitative value representing relative gene expression levels. See, for example, U.S. Pat. Nos. 6,040,138, 5,800,992 and 6,020,135, 6,033,860, and 6,344,316, each incorporated by reference in their entireties. High-density oligonucleotide arrays are particularly useful for determining the gene expression profile for a large number of RNAs in a sample.

Techniques for the synthesis of these arrays using mechanical synthesis methods are described in, for example, U.S. Pat. No. 5,384,261. Although a planar array surface is generally used, the array can be fabricated on a surface of virtually any shape or even a multiplicity of surfaces. Arrays can be nucleic acids (or peptides) on beads, gels, polymeric surfaces, fibers (such as fiber optics), glass, or any other appropriate substrate. See, for example, U.S. Pat. Nos. 5,770,358, 5,789,162, 5,708,153, 6,040,193 and 5,800,992, each incorporated by reference in their entireties. Arrays can be packaged in such a manner as to allow for diagnostics or other manipulation of an all-inclusive device. See, for example, U.S. Pat. Nos. 5,856,174 and 5,922,591, each incorporated by reference in their entireties.

Serial analysis of gene expression (SAGE) in one embodiment is employed in the methods described herein. SAGE is a method that allows the simultaneous and quantitative analysis of a large number of gene transcripts, without the need of providing an individual hybridization probe for each transcript. First, a short sequence tag (about 10-14 bp) is generated that contains sufficient information to uniquely identify a transcript, provided that the tag is obtained from a unique position within each transcript. Then, many transcripts are linked together to form long serial molecules, that can be sequenced, revealing the identity of the multiple tags simultaneously. The expression pattern of any population of transcripts can be quantitatively evaluated by determining the abundance of individual tags, and identifying the gene corresponding to each tag. See, Velculescu et al. Science 270:484-87, 1995; Cell 88:243-51, 1997, incorporated by reference in its entirety.

An additional method of biomarker level analysis at the nucleic acid level is the use of a sequencing method, for example, RNAseq, next generation sequencing, and massively parallel signature sequencing (MPSS), as described by Brenner et al. (Nat. Biotech. 18:630-34, 2000, incorporated by reference in its entirety). This is a sequencing approach that combines non-gel-based signature sequencing with in vitro cloning of millions of templates on separate 5 μm diameter microbeads. First, a microbead library of DNA templates is constructed by in vitro cloning. This is followed by the assembly of a planar array of the template-containing microbeads in a flow cell at a high density (typically greater than $3.0\times10^6$ microbeads/$cm^2$). The free ends of the cloned templates on each microbead are analyzed simultaneously, using a fluorescence-based signature sequencing method that does not require DNA fragment separation. This method has been shown to simultaneously and accurately provide, in a single operation, hundreds of thousands of gene signature sequences from a yeast cDNA library.

Another method of biomarker level analysis at the nucleic acid level is the use of an amplification method such as, for example, RT-PCR or quantitative RT-PCR (qRT-PCR). Methods for determining the level of biomarker mRNA in a sample may involve the process of nucleic acid amplification, e.g., by RT-PCR (the experimental embodiment set forth in Mullis, 1987, U.S. Pat. No. 4,683,202), ligase chain reaction (Barany (1991) Proc. Natl. Acad. Sci. USA 88:189-193), self-sustained sequence replication (Guatelli et al.

(1990) Proc. Natl. Acad. Sci. USA 87:1874-1878), transcriptional amplification system (Kwoh et al. (1989) Proc. Natl. Acad. Sci. USA 86:1173-1177), Q-Beta Replicase (Lizardi et al. (1988) Bio/Technology 6:1197), rolling circle replication (Lizardi et al., U.S. Pat. No. 5,854,033) or any other nucleic acid amplification method, followed by the detection of the amplified molecules using techniques well known to those of skill in the art. Numerous different PCR or qRT-PCR protocols are known in the art and can be directly applied or adapted for use using the presently described compositions for the detection and/or quantification of expression of discriminative genes in a sample. See, for example, Fan et al. (2004) Genome Res. 14:878-885, herein incorporated by reference. Generally, in PCR, a target polynucleotide sequence is amplified by reaction with at least one oligonucleotide primer or pair of oligonucleotide primers. The primer(s) hybridize to a complementary region of the target nucleic acid and a DNA polymerase extends the primer(s) to amplify the target sequence. Under conditions sufficient to provide polymerase-based nucleic acid amplification products, a nucleic acid fragment of one size dominates the reaction products (the target polynucleotide sequence which is the amplification product). The amplification cycle is repeated to increase the concentration of the single target polynucleotide sequence. The reaction can be performed in any thermocycler commonly used for PCR.

Quantitative RT-PCR (qRT-PCR) (also referred as real-time RT-PCR) is preferred under some circumstances because it provides not only a quantitative measurement, but also reduced time and contamination. As used herein, "quantitative PCR" (or "real time qRT-PCR") refers to the direct monitoring of the progress of a PCR amplification as it is occurring without the need for repeated sampling of the reaction products. In quantitative PCR, the reaction products may be monitored via a signaling mechanism (e.g., fluorescence) as they are generated and are tracked after the signal rises above a background level but before the reaction reaches a plateau. The number of cycles required to achieve a detectable or "threshold" level of fluorescence varies directly with the concentration of amplifiable targets at the beginning of the PCR process, enabling a measure of signal intensity to provide a measure of the amount of target nucleic acid in a sample in real time. A DNA binding dye (e.g., SYBR green) or a labeled probe can be used to detect the extension product generated by PCR amplification. Any probe format utilizing a labeled probe comprising the sequences of the invention may be used.

Immunohistochemistry methods are also suitable for detecting the levels of the biomarkers of the present invention. Samples can be frozen for later preparation or immediately placed in a fixative solution. Tissue samples can be fixed by treatment with a reagent, such as formalin, gluteraldehyde, methanol, or the like and embedded in paraffin. Methods for preparing slides for immunohistochemical analysis from formalin-fixed, paraffin-embedded tissue samples are well known in the art.

In one embodiment, the levels of the biomarkers provided herein, such as the classifier biomarkers of Tables 1-4 (or subsets thereof as provided herein), are normalized against the expression levels of all RNA transcripts or their non-natural cDNA expression products, or protein products in the sample, or of a reference set of RNA transcripts or a reference set of their non-natural cDNA expression products, or a reference set of their protein products in the sample.

In one embodiment, the detecting, determining or measuring the expression level of any biomarker, including each member of a biomarker pair, in any of the methods provided herein is performed at the protein level. In one embodiment, an FAS can be evaluated using levels of protein expression of one or more of the classifier genes provided herein, such as the classifier biomarkers listed in Tables 1-4. The level of protein expression can be measured using an immunological detection method. Immunological detection methods which can be used herein include, but are not limited to, competitive and non-competitive assay systems using techniques such as Western blots, radioimmunoassays, ELISA (enzyme linked immunosorbent assay), "sandwich" immunoassays, immunoprecipitation assays, precipitin reactions, gel diffusion precipitin reactions, immunodiffusion assays, agglutination assays, complement-fixation assays, immunoradiometric assays, fluorescent immunoassays, protein A immunoassays, and the like. Such assays are routine and well known in the art (see, e.g., Ausubel et al, eds, 1994, *Current Protocols in Molecular Biology*, Vol. I, John Wiley & Sons, Inc., New York, which is incorporated by reference herein in its entirety).

In one embodiment, antibodies specific for biomarker proteins are utilized to detect the expression of a biomarker protein in a body sample. The method comprises obtaining a body sample from a patient or a subject, contacting the body sample with at least one antibody directed to a biomarker selected from Tables 1 or 2, or at least one pair of antibodies such that each member of the pair is directed to a biomarker pair select from Tables 3 or 4, and detecting antibody binding to determine if the biomarker or biomarker pair is expressed in the patient sample. One of skill in the art will recognize that the immunocytochemistry method described herein below may be performed manually or in an automated fashion.

As provided throughout, the methods set forth herein provide a method for determining an FAS of a subject. Once the biomarker levels are determined, for example by measuring non-natural cDNA biomarker levels or non-natural mRNA-cDNA biomarker complexes, the biomarker levels can be compared to reference values or a reference sample, for example with the use of statistical methods or direct comparison of detected levels, to make a determination of the FAS. Based on the comparison, the patient's sample is classified as being FAS (+) or (−).

In one embodiment, expression level values of the at least one classifier biomarkers provided herein, such as the classifier biomarkers of Table 1 or Table 2 are compared to reference expression level value(s) from at least one sample training set, wherein the at least one sample training set comprises expression level values from a reference sample(s). In a further embodiment, the at least one sample training set comprises expression level values of the at least one classifier biomarker or plurality of classifier biomarkers provided herein, such as the classifier biomarkers of Table 1 or Table 2 from a sample known to possess one or more alterations or mutations in an fgfr3 gene alone, a sample known not to possesses one or more alterations or mutations in an fgfr3 gene alone or a combination thereof. The one or more alterations or mutations in the fgfr3 gene can be any mutation and/or fusion in the fgfr3 gene known in the art. In one embodiment, the one or more alterations or mutations in the fgfr3 gene are selected from those mutations that encode an FGFR3 protein with a S249C, R248C, Y373C, R248C, S249C, G370C, G372C, Y373C or Y375C mutation. In one embodiment, the one or more alterations or mutations in the fgfr3 gene can be selected from a fusion of the fgfr3-tacc3 genes that encode an FGFR3-TACC3 fusion protein and a fusion of the fgfr3-baiap2l1 genes that encode an FGFR3-

BAIAP2L1 fusion protein. Methods for comparing detected levels of biomarkers to reference values and/or reference samples are provided herein. Based on this comparison, in one embodiment a correlation between the biomarker levels obtained from the subject's sample and the reference values is obtained. An assessment of the FAS is then made.

In a separate embodiment, hybridization values of the at least one classifier biomarkers provided herein, such as the classifier biomarkers of Table 1 or Table 2 are compared to reference hybridization value(s) from at least one sample training set, wherein the at least one sample training set comprises hybridization values from a reference sample(s). In a further embodiment, the at least one sample training set comprises hybridization values of the at least one classifier biomarker or plurality of classifier biomarkers provided herein, such as the classifier biomarkers of Table 1 or Table 2 from a sample known to possess one or more alterations or mutations in an fgfr3 gene alone, a sample known not to possesses one or more alterations or mutations in an fgfr3 gene alone or a combination thereof. The one or more alterations or mutations in the fgfr3 gene can be any mutation and/or fusion in the fgfr3 gene known in the art. In one embodiment, the one or more alterations or mutations in the fgfr3 gene are selected from those mutations that encode an FGFR3 protein with a S249C, R248C, Y373C, R248C, S249C, G370C, G372C, Y373C or Y375C mutation. In one embodiment, the one or more alterations or mutations in the fgfr3 gene can be selected from a fusion of the fgfr3-tacc3 genes that encode an FGFR3-TACC3 fusion protein and a fusion of the fgfr3-baiap2l1 genes that encode an FGFR3-BAIAP2L1 fusion protein. Methods for comparing detected levels of biomarkers to reference values and/or reference samples are provided herein. Based on this comparison, in one embodiment a correlation between the biomarker levels obtained from the subject's sample and the reference values is obtained. An assessment of the FAS is then made.

Sample Types

In one embodiment, the sample used in any method provided herein is obtained from an individual and comprises formalin-fixed paraffin-embedded (FFPE) tissue. However, other tissue and sample types are amenable for use in any of the methods provided herein. In one embodiment, the other tissue and sample types can be fresh frozen tissue, wash fluids or cell pellets, or the like. In one embodiment, the sample can be a bodily fluid obtained from the individual. The bodily fluid can be blood or fractions thereof (e.g., serum, plasma), urine, sputum, saliva or cerebrospinal fluid (CSF). A biomarker or each biomarker in a pair of biomarkers for use in any method or composition provided herein can be a nucleic acid. A biomarker nucleic acid (e.g., DNA or RNA) as provided herein can be extracted from a cell or can be cell free or extracted from an extracellular vesicular entity such as an exosome or microvesicle. The sample can contain cellular as well as extracellular sources of nucleic acid for use in the methods provided herein. The methods provided herein, including the RT-PCR methods, can be sensitive, precise and have multi-analyte capability for use with paraffin embedded samples. See, for example, Cronin et al. (2004) *Am. J Pathol.* 164(1):35-42, herein incorporated by reference.

Formalin fixation and tissue embedding in paraffin wax is a universal approach for tissue processing prior to light microscopic evaluation. A major advantage afforded by formalin-fixed paraffin-embedded (FFPE) specimens is the preservation of cellular and architectural morphologic detail in tissue sections. (Fox et al. (1985) J Histochem Cytochem 33:845-853). The standard buffered formalin fixative in which biopsy specimens are processed is typically an aqueous solution containing 37% formaldehyde and 10-15% methyl alcohol. Formaldehyde is a highly reactive dipolar compound that results in the formation of protein-nucleic acid and protein-protein crosslinks in vitro (Clark et al. (1986) J Histochem Cytochem 34:1509-1512; McGhee and von Hippel (1975) Biochemistry 14:1281-1296, each incorporated by reference herein).

Methods are known in the art for the isolation of RNA from FFPE tissue. In one embodiment, total RNA can be isolated from FFPE tissues as described by Bibikova et al. (2004) American Journal of Pathology 165:1799-1807, herein incorporated by reference. Likewise, the High Pure RNA Paraffin Kit (Roche) can be used. Paraffin is removed by xylene extraction followed by ethanol wash. RNA can be isolated from sectioned tissue blocks using the MasterPure® Purification kit (Epicenter, Madison, Wis.); a DNase I treatment step is included. RNA can be extracted from frozen samples using Trizol reagent according to the supplier's instructions (Invitrogen Life Technologies, Carlsbad, Calif.). Samples with measurable residual genomic DNA can be re-subjected to DNaseI treatment and assayed for DNA contamination. All purification, DNase treatment, and other steps can be performed according to the manufacturer's protocol. After total RNA isolation, samples can be stored at −80° C. until use.

General methods for mRNA extraction are well known in the art and are disclosed in standard textbooks of molecular biology, including Ausubel et al., ed., Current Protocols in Molecular Biology, John Wiley & Sons, New York 1987-1999. Methods for RNA extraction from paraffin embedded tissues are disclosed, for example, in Rupp and Locker (Lab Invest. 56:A67, 1987) and De Andres et al. (Biotechniques 18:42-44, 1995). In particular, RNA isolation can be performed using a purification kit, a buffer set and protease from commercial manufacturers, such as Qiagen (Valencia, Calif.), according to the manufacturer's instructions. For example, total RNA from cells in culture can be isolated using Qiagen RNeasy mini-columns. Other commercially available RNA isolation kits include MasterPure®. Complete DNA and RNA Purification Kit (Epicentre, Madison, Wis.) and Paraffin Block RNA Isolation Kit (Ambion, Austin, Tex.). Total RNA from tissue samples can be isolated, for example, using RNA Stat-60 (Tel-Test, Friendswood, Tex.). RNA prepared from a tumor can be isolated, for example, by cesium chloride density gradient centrifugation. Additionally, large numbers of tissue samples can readily be processed using techniques well known to those of skill in the art, such as, for example, the single-step RNA isolation process of Chomczynski (U.S. Pat. No. 4,843,155, incorporated by reference in its entirety for all purposes).

In one embodiment, a sample for use in any of the methods provided herein comprises cells harvested from a tissue sample, for example, a tumor sample. The tumor sample can be a cancerous tumor. The cancerous tumor can be any type of cancer known in the art and/or provided herein. Cells can be harvested from a biological sample using standard techniques known in the art. For example, in one embodiment, cells are harvested by centrifuging a cell sample and resuspending the pelleted cells. The cells can be resuspended in a buffered solution such as phosphate-buffered saline (PBS). After centrifuging the cell suspension to obtain a cell pellet, the cells can be lysed to extract nucleic acid, e.g, messenger RNA. All samples obtained from a subject, including those subjected to any sort of further processing, are considered to be obtained from the subject.

The sample, in one embodiment, is further processed before the detection of the biomarker levels of the combination of biomarkers set forth herein. For example, mRNA in a cell or tissue sample can be separated from other components of the sample. The sample can be concentrated and/or purified to isolate mRNA in its non-natural state, as the mRNA is not in its natural environment. For example, studies have indicated that the higher order structure of mRNA in vivo differs from the in vitro structure of the same sequence (see, e.g., Rouskin et al. (2014). Nature 505, pp. 701-705, incorporated herein in its entirety for all purposes).

mRNA from the sample in one embodiment, is hybridized to a synthetic DNA probe, which in some embodiments, includes a detection moiety (e.g., detectable label, capture sequence, barcode reporting sequence). Accordingly, in these embodiments, a non-natural mRNA-cDNA complex is ultimately made and used for detection of the biomarker. In another embodiment, mRNA from the sample is directly labeled with a detectable label, e.g., a fluorophore. In a further embodiment, the non-natural labeled-mRNA molecule is hybridized to a cDNA probe and the complex is detected.

In one embodiment, once the mRNA is obtained from a sample, it is converted to complementary DNA (cDNA) in a hybridization reaction or is used in a hybridization reaction together with one or more cDNA probes. cDNA does not exist in vivo and therefore is a non-natural molecule. Furthermore, cDNA-mRNA hybrids are synthetic and do not exist in vivo. Besides cDNA not existing in vivo, cDNA is necessarily different than mRNA, as it includes deoxyribonucleic acid and not ribonucleic acid. The cDNA is then amplified, for example, by the polymerase chain reaction (PCR) or other amplification method known to those of ordinary skill in the art. For example, other amplification methods that may be employed include the ligase chain reaction (LCR) (Wu and Wallace, Genomics, 4:560 (1989), Landegren et al., Science, 241:1077 (1988), incorporated by reference in its entirety for all purposes, transcription amplification (Kwoh et al., *Proc. Natl. Acad. Sci. USA,* 86:1173 (1989), incorporated by reference in its entirety for all purposes), self-sustained sequence replication (Guatelli et al., *Proc. Nat. Acad. Sci. USA,* 87:1874 (1990), incorporated by reference in its entirety for all purposes), incorporated by reference in its entirety for all purposes, and nucleic acid based sequence amplification (NASBA). Guidelines for selecting primers for PCR amplification are known to those of ordinary skill in the art. See, e.g., McPherson et al., PCR Basics: From Background to Bench, Springer-Verlag, 2000, incorporated by reference in its entirety for all purposes. The product of this amplification reaction, i.e., amplified cDNA is also necessarily a non-natural product. First, as mentioned above, cDNA is a non-natural molecule. Second, in the case of PCR, the amplification process serves to create hundreds of millions of cDNA copies for every individual cDNA molecule of starting material. The numbers of copies generated are far removed from the number of copies of mRNA that are present in vivo.

In one embodiment, cDNA is amplified with primers that introduce an additional DNA sequence (e.g., adapter, reporter, capture sequence or moiety, barcode) onto the fragments (e.g., with the use of adapter-specific primers), or mRNA or cDNA biomarker sequences are hybridized directly to a cDNA probe comprising the additional sequence (e.g., adapter, reporter, capture sequence or moiety, barcode). Amplification and/or hybridization of mRNA to a cDNA probe therefore serves to create non-natural double stranded molecules from the non-natural single stranded cDNA, or the mRNA, by introducing additional sequences and forming non-natural hybrids. Further, as known to those of ordinary skill in the art, amplification procedures have error rates associated with them. Therefore, amplification introduces further modifications into the cDNA molecules. In one embodiment, during amplification with the adapter-specific primers, a detectable label, e.g., a fluorophore, is added to single strand cDNA molecules. Amplification therefore also serves to create DNA complexes that do not occur in nature, at least because (i) cDNA does not exist in vivo, (i) adapter sequences are added to the ends of cDNA molecules to make DNA sequences that do not exist in vivo, (ii) the error rate associated with amplification further creates DNA sequences that do not exist in vivo, (iii) the disparate structure of the cDNA molecules as compared to what exists in nature, and (iv) the chemical addition of a detectable label to the cDNA molecules.

In some embodiments, the expression of a biomarker of interest (e.g., one or a plurality of biomarkers from Table 1 or Table 2) and/or a biomarker pair of interest (e.g., one or a plurality of biomarker pairs from Table 3 or 4) is detected at the nucleic acid level via detection of non-natural cDNA molecules.

Types of Cancer

Further to any of the embodiments provided herein, the sample obtained from a subject subjected any of the methods provided herein can be a tumor sample. The tumor sample can be a cancerous tumor. The cancer can include, but is not limited to, carcinoma, lymphoma, blastoma (including medulloblastoma and retinoblastoma), sarcoma (including liposarcoma and synovial cell sarcoma), neuroendocrine tumors (including carcinoid tumors, gastrinoma, and islet cell cancer), mesothelioma, schwannoma (including acoustic neuroma), meningioma, adenocarcinoma, melanoma, and leukemia or lymphoid malignancies. Examples of a cancer also include, but are not limited to, a lung cancer (e.g., a non-small cell lung cancer (NSCLC) such as lung adenocarcinoma (LUAD) or lung squamous cell carcinoma (LUSC)), a kidney cancer (e.g., a kidney urothelial carcinoma or RCC), a bladder cancer (e.g., a bladder urothelial (transitional cell) carcinoma (e.g., locally advanced or metastatic urothelial cancer, including 1L or 2L+locally advanced or metastatic urothelial carcinoma), a muscle invasive bladder cancer (MIBC), a breast cancer, a colorectal cancer (e.g., a colon adenocarcinoma), an ovarian cancer, a pancreatic cancer (e.g., pancreatic adenocarcinoma or PAAD), a gastric carcinoma, an esophageal cancer, a mesothelioma, a melanoma (e.g., a skin melanoma), a head and neck cancer (e.g., a head and neck squamous cell carcinoma (HNSCC)), a thyroid cancer, a sarcoma (e.g., a soft-tissue sarcoma, a fibrosarcoma, a myxosarcoma, a liposarcoma, an osteogenic sarcoma, an osteosarcoma, a chondrosarcoma, an angiosarcoma, an endotheliosarcoma, a lymphangiosarcoma, a lymphangioendotheliosarcoma, a leiomyosarcoma, or a rhabdomyosarcoma), a prostate cancer, a glioblastoma, a cervical cancer, a thymic carcinoma, a leukemia (e.g., an acute lymphocytic leukemia (ALL), an acute myelocytic leukemia (AML), a chronic myelocytic leukemia (CML), a chronic eosinophilic leukemia, or a chronic lymphocytic leukemia (CLL)), a lymphoma (e.g., a Hodgkin lymphoma or a non-Hodgkin lymphoma (NHL)), a myeloma (e.g., a multiple myeloma (MM)), a mycosis fungoides, a Merkel cell cancer, a hematologic malignancy, a cancer of hematological tissues, a B cell cancer, a bronchus cancer, a stomach cancer, a brain or central nervous system cancer, a peripheral nervous system cancer, a uterine or endometrial cancer, a cancer of the oral cavity or pharynx, a liver cancer, a testicular cancer, a biliary tract cancer, a small bowel or appendix cancer, a salivary gland cancer, an adrenal gland cancer, an adenocarcinoma, an inflammatory myofibroblastic tumor, a gastrointestinal stromal tumor (GIST), a colon cancer, a myelodysplastic syndrome (MDS), a myeloproliferative disorder (MPD), a polycythemia Vera, a chordoma, a synovioma, an Ewing's tumor, a squamous cell carcinoma, a basal cell carcinoma, an adenocarcinoma, a sweat gland carcinoma, a sebaceous gland carcinoma, a papillary carcinoma, a papillary adenocarcinoma, a medullary carcinoma, a bronchogenic carcinoma, a renal cell carcinoma, a hepatoma, a bile duct carcinoma, a choriocarcinoma, a seminoma, an embryonal carcinoma, a Wilms' tumor, a bladder carcinoma, an epithelial carcinoma, a glioma, an astrocytoma, a medulloblastoma, a craniopharyngioma, an ependymoma, a pinealoma, a hemangioblastoma, an acoustic neuroma, an oligodendroglioma, a meningioma, a neuroblastoma, a retinoblastoma, a follicular lymphoma, a diffuse large B-cell lymphoma, a mantle cell lymphoma, a hepatocellular carcinoma, a thyroid cancer, a small cell cancer, an essential thrombocythemia, an agnogenic myeloid metaplasia, a hypereosinophilic syndrome, a systemic mastocytosis, a familiar hypereosinophilia, a neuroendocrine cancer, or a carcinoid tumor.

In some cases, the cancer that the subject from which a sample is obtained is suffering or suspected of suffering from is selected from a cervical kidney renal papillary cell carcinoma (KIRP); breast invasive carcinoma (BRCA); thyroid cancer (THCA); bladder carcinoma (BLCA); prostate adenocarcinoma (PRAD); kidney chromophobe (KICH); cervical squamous cell carcinoma and endocervical adenocarcinoma (CESC); kidney renal clear cell carcinoma (KIRC); liver hepatocellular carcinoma (LIHC); low grade glioma (LGG); sarcoma (SARC); lung adenocarcinoma (LUAD); colon adenocarcinoma (COAD); head-neck squamous cell carcinoma (HNSC or HNSCC); uterine corpus endometrial carcinoma (UCEC), glioblastoma multiforme (GBM); esophageal carcinoma (ESCA); stomach adenocarcinoma (STAD); ovarian cancer (OV); rectum adenocarcinoma (READ), pancreatic adenocarcinoma (PAAD), diffuse large B-cell lymphoma (DLBC), cholangiocarcinmoa (CHOL), sarcoma (SARC), skin cutaneous melanoma (SKCM), testicular germ cell tumors (TGCT), thymoma (THYM), uterine carcinosarcoma (UCS), uveal Melanoma (UVM), pheochromocytoma and paraganglioma (PCPG), adrenocortical carcinoma (ACC); mesothelioma (MESO) or lung squamous cell carcinoma (LUSC), an esophageal cancer, a mesothelioma, a melanoma, a head and neck cancer, a thyroid cancer, a sarcoma, a prostate cancer, a glioblastoma, a cervical cancer, a thymic carcinoma, a leukemia, a lymphoma, a myeloma, a mycosis fungoides, a merkel cell cancer, an endometrial cancer. In some cases, the cancer is LUAD, LGG, LIHC, KIRC, KICH, MESO, ACC or KIRP. In some cases, cancer can be selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM.

Statistical Methods

Various statistical methods can be used to aid in the comparison of the biomarker levels obtained from the patient and reference biomarker levels, for example, from at least one sample training set.

In one embodiment, a supervised pattern recognition method is employed. Examples of supervised pattern recognition methods can include, but are not limited to, the nearest centroid methods (Dabney (2005) Bioinformatics 21(22):4148-4154 and Tibshirani et al. (2002) Proc. Natl. Acad. Sci. USA 99(10):6576-6572); soft independent modeling of class analysis (SIMCA) (see, for example, Wold, 1976); partial least squares analysis (PLS) (see, for example, Wold, 1966; Joreskog, 1982; Frank, 1984; Bro, R., 1997); linear discriminant analysis (LDA) (see, for example, Nillson, 1965); K-nearest neighbor analysis (KNN) (sec, for example, Brown et al., 1996); artificial neural networks (ANN) (see, for example, Wasserman, 1989; Anker et al., 1992; Hare, 1994); probabilistic neural networks (PNNs) (see, for example, Parzen, 1962; Bishop, 1995; Speckt, 1990; Broomhead et al., 1988; Patterson, 1996); rule induction (RI) (see, for example, Quinlan, 1986); and, Bayesian methods (see, for example, Bretthorst, 1990a, 1990b, 1988). In one embodiment, the classifier for identifying tumor subtypes based on gene expression data is the centroid based method described in Mullins et al. (2007) Clin Chem. 53(7):1273-9, each of which is herein incorporated by reference in its entirety. In another embodiment, the classifier for identifying an FAS based on gene expression data is used in a nearest centroid based method as described in Dabney (2005) Bioinformatics 21(22):4148-4154, which is incorporated herein by reference in its entirety. The nearest centroid based method can be performed using CLaNC software as described in Dabney AR. ClaNC: Point-and-click software for classifying microarrays to nearest centroids. Bioinformatics. 2006; 22: 122-123 or equivalents or derivatives thereof.

In other embodiments, an unsupervised training approach is employed, and therefore, no training set is used.

In one embodiment, a rank-based classifier such as the Top Scoring Pair (TSP; Leek, 2009) and kTSP (Afsari et al., 2014) is employed. Rank-based classifiers such as the Top Scoring Pair (TSP; Leek, 2009) and kTSP (Afsari et al., 2014) depend only on the relative ranks of the expression of genes within a sample, allowing such classifiers to be robust against platform-specific effects and study-to-study variations due to data normalization and preprocessing (Patil et al., 2015)

The kTSP approach can select k pairs of genes A and B such that gene A expression>gene B expression implies sample membership to class 1 (e.g., FAS (+)), otherwise implying membership to class 2 (e.g., (FAS (−)). The default decision rule in Afsari et al., 2015 following feature selection weights each TSP equally in their class prediction ("voting"), despite the fact that some TSPs may better discriminate between classes than others. The kTSP approach of Afsari et al., 2015 can be utilized to generate a rank-based classifier for use in the methods described herein by implementing a custom decision rule that inputs the selected k gene pairs into a penalized logistic regression classifier to estimate the relative contribution each of the k selected TSPs in predicting class membership (defined here as FAS (+) versus otherwise), similar to (Shi et al., 2011). In fitting the model, class membership can be the binary outcome variable, and each covariate can correspond to a TSP, consisting of a binary integer vector which can take on the value of 1 for a sample if gene A>gene B in expression for that TSP, and 0 otherwise for each sample.

Referring to sample training sets for supervised learning approaches again, in some embodiments, a sample training set(s) can include expression data of a plurality or all of the classifier biomarkers (e.g., all the classifier biomarkers of Table 1 or Table 2) from sample (e.g., tumor sample). In some cases, the plurality of biomarker comprises, consists essentially of or consists of exactly, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128 or 129 biomarkers of Table 1. In some cases, the plurality of biomarker comprises, consists essentially of or consists of all the biomarkers of Table 1. In some cases, the plurality of biomarker consists of only the biomarkers of Table 1. In some cases, the plurality of biomarker comprises, consists essentially of or consists of exactly, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, or 79 biomarkers of Table 2. In some cases, the plurality of biomarker comprises, consists essentially of or consists of all the biomarkers of Table 2. In some cases, the plurality of biomarker consists of only the biomarkers of Table 2. The detection can be by using any amplification, hybridization and/or sequencing assay disclosed herein. In some cases, the plurality of biomarker comprises, consists essentially of or consists of a subset of biomarkers of Table 1 and Table 2. In some cases, the plurality of biomarker comprises, consists essentially of or consists of all the biomarkers of Table 1 and Table 2. In some cases, the plurality of biomarker consists of only the biomarkers of Table 1 and Table 2. In some embodiments, the sample training set(s) are normalized to remove sample-to-sample variation.

In some embodiments, comparing can include applying a statistical algorithm, such as, for example, any suitable multivariate statistical analysis model, which can be parametric or non-parametric. In some embodiments, applying the statistical algorithm can include determining a correlation between the expression data obtained from the human lung tissue sample and the expression data from the adenocarcinoma training set(s). In some embodiments, cross-validation is performed, such as (for example), leave-one-out cross-validation (LOOCV). In some embodiments, integrative correlation is performed. In some embodiments, a Spearman correlation is performed. In some embodiments, a centroid based method is employed for the statistical algorithm. The centroids can be constructed using any method known in the art for generating centroids such as, for example, those found in Mullins et al. (2007) Clin Chem. 53(7):1273-9 or the nearest centroid method found in Dabney (2005) Bioinformatics 21(22):4148-4154, which is herein incorporated by reference in its entirety. In one embodiment, a correlation analysis is performed on the expression data obtained from the sample obtained from a subject suffering or suspected of suffering from a cancer and the centroid(s) constructed on the expression data from the training set(s). The correlation analysis can be a Spearman correlation or a Pearson correlation. In one embodiment, a distance measure analysis (e.g., Euclidean distance) is performed on the expression data obtained from the sample and the centroid(s) constructed on the expression data from the training set(s).

Results of the gene expression performed on a sample from a subject (test sample) may be compared to a biological sample(s) or data derived from a reference biological sample(s). In some embodiments for assessing an FAS, a reference sample or reference gene expression data is obtained or derived from an individual known to have a positive FAS (in other words to possess one or more known FGFR3 mutations and/or fusions) or negative FAS (in other words, free of known FGFR3 mutations and/or fusions). In one embodiment, the gene expression levels or profile for the at least one or plurality of classifier biomarker provided herein (e.g., Table 1 or 2) measured or detected in the test sample may be compared to centroids constructed from the gene expression performed on the reference sample. The centroids can be constructed using any of the methods provided herein such as, for example, using the ClaNC software described in Dabney AR. ClaNC: Point-and-click software for classifying microarrays to nearest centroids. Bioinformatics. 2006; 22: 122-123 or equivalents or derivatives related thereto. Classification or determination of the subtype of the test sample can then be ascertained by determining the nearest centroid from the reference or normal sample to which the expression levels or profile from said test sample is nearest based on a distance measure or correlation. The distance measure can be a Euclidean distance. In embodiments related to determining an FAS, the FAS (+) or FAS (−) centroids can be the centroids found in Table 1 or Table 2.

The reference sample may be assayed at the same time, or at a different time from the test sample. Alternatively, the biomarker level information from a reference sample may be stored in a database or other means for access at a later date.

The biomarker level results of an assay on the test sample may be compared to the results of the same assay on a reference sample. In some cases, the results of the assay on the reference sample are from a database, or a reference value(s). In some cases, the results of the assay on the reference sample are a known or generally accepted value or range of values by those skilled in the art. In some cases, the comparison is qualitative. In other cases, the comparison is quantitative. In some cases, qualitative or quantitative comparisons may involve but are not limited to one or more of the following: comparing fluorescence values, spot intensities, absorbance values, chemiluminescent signals, histograms, critical threshold values, statistical significance values, expression levels of the genes or gene pairs (e.g., gene A and gene B) described herein, mRNA copy numbers.

In one embodiment, an odds ratio (OR) is calculated for each biomarker or biomarker pair expression level measurement. Here, the OR is a measure of association between the measured biomarker or biomarker pair values for the patient and an outcome, e.g., FGFR3 activation signature. For example, see, *J. Can. Acad. Child Adolesc. Psychiatry* 2010; 19(3): 227-229, which is incorporated by reference in its entirety for all purposes.

In one embodiments, the methods provided herein for determining an FGFR3 mutational or activation status of sample obtained from a subject suffering form or suspected of suffering from a cancer can utilize a rank-based classifier such as, for example, the rank-based classifiers of Tables 3 or 4. Accordingly, in some cases, determining the FGFR3 mutational status requires measuring the expression level of gene A and gene B from one or more classifier biomarker gene pairs from Table 3 or Table 4, and subsequently determining a score for the sample using the expression level of gene A and gene B for each classifier biomarker gene pair whose expression level was determined and the intercept from Table 3 or Table 4 such that for each gene pair from the one or the plurality of biomarker gene pairs selected from Table 3 or Table 4 where the detected expression level of gene A is greater than the detected expression level of gene B, the coefficient for that gene pair from Table 3 or Table 4 is inputted into EQUATION 1 along with the classifier model intercept from Table 3 or Table 4. The sum of all such coefficients and the intercept from Table 3 or Table 4 represents the score of the sample. If the score of the sample is greater than zero, then the sample is deemed to have a positive FGFR3 activation signature. If the score of the sample is less than or equal to zero, then the sample is deemed to have a negative FGFR3 activation signature.

In one embodiment, a specified statistical confidence level may be determined in order to provide a confidence level regarding any one or a combination of the FGFR3 activation signatures provided herein. For example, it may be determined that a confidence level of greater than 90% may be a useful predictor of any one or a combination of the FGFR3 activation signatures provided herein. In other embodiments, more or less stringent confidence levels may be chosen. For example, a confidence level of about or at least about 50%, 60%, 70%, 75%, 80%, 85%, 90%, 95%, 97.5%, 99%, 99.5%, or 99.9% may be chosen. The confidence level provided may in some cases be related to the quality of the sample, the quality of the data, the quality of the analysis, the specific methods used, and/or the number of gene expression values (i.e., the number of genes) analyzed. The specified confidence level for providing the likelihood of response may be chosen on the basis of the expected number of false positives or false negatives. Methods for choosing parameters for achieving a specified confidence level or for identifying markers with diagnostic power include but are not limited to Receiver Operating Characteristic (ROC) curve analysis, binormal ROC, principal component analysis, odds ratio analysis, partial least squares analysis, singular value decomposition, least absolute shrinkage and selection operator analysis, least angle regression, and the threshold gradient directed regularization method.

Determining any one or a combination of the FGFR3 activation signatures provided herein in some cases can be improved through the application of algorithms designed to normalize and or improve the reliability of the gene expression data. In some embodiments of the present invention, the data analysis utilizes a computer or other device, machine or apparatus for application of the various algorithms described herein due to the large number of individual data points that are processed. A "machine learning algorithm" refers to a computational-based prediction methodology, also known to persons skilled in the art as a "classifier," employed for characterizing a gene expression profile or profiles, e.g., to determine any one or a combination of the FGFR3 activation signatures provided herein. The biomarker levels, determined by, e.g., microarray-based hybridization assays, sequencing assays, NanoString assays, etc., are in one embodiment subjected to the algorithm in order to classify the profile. In embodiments related to assessing any one or a combination of the FGFR3 activation signatures provided herein, supervised learning generally involves "training" a classifier to recognize the distinctions among an FGFR3 activation signature positive or non-FGFR3 activation signature, and then "testing" the accuracy of the classifier on an independent test set. Therefore, for new, unknown samples the classifier can be used to predict, for example, the class (e.g., FAS (+) vs. FAS (−)) in which the samples belong.

In some embodiments, a robust multi-array average (RMA) method may be used to normalize raw data. The RMA method begins by computing background-corrected intensities for each matched cell on a number of microarrays. In one embodiment, the background corrected values are restricted to positive values as described by Irizarry et al. (2003). Biostatistics April 4 (2): 249-64, incorporated by reference in its entirety for all purposes. After background correction, the base-2 logarithm of each background corrected matched-cell intensity is then obtained. The background corrected, log-transformed, matched intensity on each microarray is then normalized using the quantile normalization method in which for each input array and each probe value, the array percentile probe value is replaced with the average of all array percentile points, this method is more completely described by Bolstad et al. Bioinformatics 2003, incorporated by reference in its entirety. Following quantile normalization, the normalized data may then be fit to a linear model to obtain an intensity measure for each probe on each microarray. Tukey's median polish algorithm (Tukey, J. W., Exploratory Data Analysis. 1977, incorporated by reference in its entirety for all purposes) may then be used to determine the log-scale intensity level for the normalized probe set data.

Various other software programs may be implemented. In certain methods, feature selection and model estimation may be performed by logistic regression with lasso penalty using glmnet (Friedman et al. (2010). *Journal of statistical software* 33(1): 1-22, incorporated by reference in its entirety). Raw reads may be aligned using TopHat (Trapnell et al. (2009). *Bioinformatics* 25(9): 1105-11, incorporated by reference in its entirety). In methods, top features (N ranging from 10 to 200) are used to train a linear support vector machine (SVM) (Suykens J A K, Vandewalle J. Least Squares Support Vector Machine Classifiers. *Neural Processing Letters* 1999; 9(3): 293-300, incorporated by reference in its entirety) using the e1071 library (Meyer D. Support vector machines: the interface to libsvm in package e1071. 2014, incorporated by reference in its entirety). Confidence intervals, in one embodiment, are computed using the pROC package (Robin X, Turck N, Hainard A, et al. pROC: an open-source package for R and S+ to analyze and compare ROC curves. *BMC bioinformatics* 2011; 12: 77, incorporated by reference in its entirety).

In addition, data may be filtered to remove data that may be considered suspect. In one embodiment, data derived from microarray probes that have fewer than about 4, 5, 6, 7 or 8 guanosine+cytosine nucleotides may be considered to be unreliable due to their aberrant hybridization propensity or secondary structure issues. Similarly, data deriving from microarray probes that have more than about 12, 13, 14, 15, 16, 17, 18, 19, 20, 21, or 22 guanosine+cytosine nucleotides may in one embodiment be considered unreliable due to their aberrant hybridization propensity or secondary structure issues.

In some embodiments of the present invention, data from probe-sets may be excluded from analysis if they are not identified at a detectable level (above background).

In some embodiments of the present disclosure, probe-sets that exhibit no, or low variance may be excluded from further analysis. Low-variance probe-sets are excluded from the analysis via a Chi-Square test. In one embodiment, a probe-set is considered to be low-variance if its transformed variance is to the left of the 99 percent confidence interval of the Chi-Squared distribution with (N−1) degrees of freedom. (N−1)*Probe-set Variance/(Gene Probe-set Variance). Chi−Sq(N−1) where N is the number of input CEL files, (N−1) is the degrees of freedom for the Chi-Squared distribution, and the "probe-set variance for the gene" is the average of probe-set variances across the gene. In some embodiments of the present invention, probe-sets for a given mRNA or group of mRNAs may be excluded from further analysis if they contain less than a minimum number of probes that pass through the previously described filter steps for GC content, reliability, variance and the like. For example in some embodiments, probe-sets for a given gene or transcript cluster may be excluded from further analysis if they contain less than about 1, 2, 3, 4, 5, 6, 7, 8, 9, 10, 11, 12, 13, 14, 15, or less than about 20 probes.

Methods of biomarker or biomarker pair level data analysis in one embodiment, further include the use of a feature selection algorithm as provided herein. In some embodiments of the present invention, feature selection is provided by use of the LIMMA software package (Smyth, G. K. (2005). Limma: linear models for microarray data. In: Bioinformatics and Computational Biology Solutions using R and Bioconductor, R. Gentleman, V. Carey, S. Dudoit, R. Irizarry, W. Huber (eds.), Springer, New York, pages 397-420, incorporated by reference in its entirety for all purposes).

Methods of biomarker or biomarker pair level data analysis, in one embodiment, include the use of a pre-classifier algorithm. For example, an algorithm may use a specific molecular fingerprint to pre-classify the samples according to their composition and then apply a correction/normalization factor. This data/information may then be fed into a final classification algorithm which would incorporate that information to aid in the final diagnosis.

Methods of biomarker level data analysis, in one embodiment, further include the use of a classifier algorithm as provided herein. In one embodiment of the present invention, a diagonal linear discriminant analysis, CLaNC, k-nearest neighbor algorithm, top scoring pair, k-top scoring pair, support vector machine (SVM) algorithm, linear support vector machine, random forest algorithm, or a probabilistic model-based method or a combination thereof is provided for classification of microarray data or RNA-seq data. In some embodiments, identified markers that distinguish samples (e.g., FAS (+), FAS (−)) are selected based on statistical significance of the difference in biomarker levels between classes of interest. In some cases, the statistical significance is adjusted by applying a Benjamin Hochberg or another correction for false discovery rate (FDR).

In some cases, the classifier algorithm may be supplemented with a meta-analysis approach such as that described by Fishel and Kaufman et al. 2007 Bioinformatics 23(13): 1599-606, incorporated by reference in its entirety for all purposes. In some cases, the classifier algorithm may be supplemented with a meta-analysis approach such as a repeatability analysis.

Methods for deriving and applying posterior probabilities to the analysis of biomarker level data are known in the art and have been described for example in Smyth, G. K. 2004 *Stat. Appi. Genet. Mol. Biol.* 3: Article 3, incorporated by reference in its entirety for all purposes. In some cases, the posterior probabilities may be used in the methods of the present invention to rank the markers provided by the classifier algorithm.

A statistical evaluation of the results of the biomarker level profiling may provide a quantitative value or values indicative of one or more of the FGFR3 activation signatures provided herein; the likelihood of the success of a particular therapeutic intervention, e.g., FGFR inhibitor therapy, angiogenesis inhibitor therapy, chemotherapy, immunotherapy or any combination thereof. In one embodiment, the data is presented directly to the physician in its most useful form to guide patient care or is used to define patient populations in clinical trials or a patient population for a given medication. The results of the molecular profiling can be statistically evaluated using a number of methods known to the art including, but not limited to: the students T test, the two sided T test, Pearson rank sum analysis, hidden Markov model analysis, analysis of q-q plots, principal component analysis, one way ANOVA, two way ANOVA, LIMMA and the like.

In some cases, accuracy may be determined by tracking the subject over time to determine the accuracy of the original diagnosis. In other cases, accuracy may be established in a deterministic manner or using statistical methods. For example, receiver operator characteristic (ROC) analysis may be used to determine the optimal assay parameters to achieve a specific level of accuracy, specificity, positive predictive value, negative predictive value, and/or false discovery rate.

In some cases, the results of the biomarker or biomarker pair level profiling assays, are entered into a database for access by representatives or agents of a molecular profiling business, the individual, a medical provider, or insurance provider. In some cases, assay results include sample classification, identification, or diagnosis by a representative, agent or consultant of the business, such as a medical professional. In other cases, a computer or algorithmic analysis of the data is provided automatically. In some cases, the molecular profiling business may bill the individual, insurance provider, medical provider, researcher, or government entity for one or more of the following: molecular profiling assays performed, consulting services, data analysis, reporting of results, or database access.

In some embodiments of the present invention, the results of the biomarker or biomarker pair level profiling assays are presented as a report on a computer screen or as a paper record. In some embodiments, the report may include, but is not limited to, such information as one or more of the following: the levels of biomarkers or biomarker pairs (e.g., as reported by copy number or fluorescence intensity, etc.) as compared to the reference sample or reference value(s); the likelihood the subject will respond to a particular therapy, based on the biomarker or biomarker pair level values and the FGFR3 activation signature or any combination of FGFR3 activation signatures and proposed therapies.

In one embodiment, the results of the gene expression profiling may be classified into one or more of the following: FGFR3 activation signature positive; possessing one or more FGFR3 alterations or mutations; FGFR3 activation signature negative; free of one or more FGFR3 alterations or mutations); likely to respond to FGFR inhibitor therapy; likely to respond to angiogenesis inhibitor, immunotherapy or chemotherapy; unlikely to respond to FGFR inhibitor therapy; unlikely to respond to angiogenesis inhibitor, immunotherapy or chemotherapy; or a combination thereof.

In some embodiments of the present invention, results are classified using a trained algorithm. Trained algorithms of the present invention include algorithms that have been developed using a reference set of known gene expression values and/or normal samples, for example, samples from individuals diagnosed with a particular FGFR3 mutation. In some cases, a reference set of known gene expression values are obtained from individuals who have been diagnosed with a particular FGFR3 mutation and are also known to respond (or not respond) to FGFR inhibitor therapy. In some cases, a reference set of known gene expression values are obtained from individuals who have been diagnosed without a particular FGFR3 mutation and are also known to respond (or not respond) to FGFR inhibitor therapy. In some cases, a reference set of known gene expression values are obtained from individuals who have been diagnosed with a FGFR3 mutation, and are also known to respond (or not respond) to a treatment modality other than FGFR inhibitor therapy (such as, for example, chemotherapy, immunotherapy, angiogenesis inhibitors, radiotherapy, surgical intervention, etc.). In some cases, a reference set of known gene expression values are obtained from individuals who have been diagnosed without a particular FGFR3 mutation and are also known to respond (or not respond) to a treatment modality other than FGFR inhibitor therapy (such as, for example, chemotherapy, immunotherapy, angiogenesis inhibitors, radiotherapy, surgical intervention, etc.).

Algorithms suitable for categorization of samples include but are not limited to k-nearest neighbor algorithms, k-top scoring pairs (TSPs), top scoring pairs (TSPs), support vector machines, linear discriminant analysis, CLaNC, diagonal linear discriminant analysis, updown, naive Bayesian algorithms, neural network algorithms, hidden Markov model algorithms, genetic algorithms, or any combination thereof.

When a binary classifier is compared with actual true values (e.g., values from a biological sample), there are typically four possible outcomes. If the outcome from a prediction is p (where "p" is a positive classifier output, such as the presence of a deletion or duplication syndrome) and the actual value is also p, then it is called a true positive (TP); however if the actual value is n then it is said to be a false positive (FP). Conversely, a true negative has occurred when both the prediction outcome and the actual value are n (where "n" is a negative classifier output, such as no deletion or duplication syndrome), and false negative is when the prediction outcome is n while the actual value is p. In one embodiment, consider a test that seeks to determine whether a person is likely or unlikely to respond to FGFR inhibitor therapy. A false positive in this case occurs when the person tests positive, but actually does respond. A false negative, on the other hand, occurs when the person tests negative, suggesting they are unlikely to respond, when they actually are likely to respond. The same holds true for classifying any one of or a combination of the FGFR3 activation signature provided herein.

The positive predictive value (PPV), or precision rate, or post-test probability of disease, is the proportion of subjects with positive test results who are correctly diagnosed as likely or unlikely to respond, or diagnosed with a positive FGFR3 activation status, or a combination thereof. It reflects the probability that a positive test reflects the underlying condition being tested for. Its value does however depend on the prevalence of the disease, which may vary. In one example the following characteristics are provided: FP (false positive); TN (true negative); TP (true positive); FN (false negative). False positive rate (a)=FP/(FP+TN)-specificity; False negative rate (β)=FN/(TP+FN)-sensitivity; Power=sensitivity=1−β; Likelihood-ratio positive=sensitivity/(l−specificity); Likelihood-ratio negative=(1−sensitivity)/specificity. The negative predictive value (NPV) is the proportion of subjects with negative test results who are correctly diagnosed.

In some embodiments, the results of the biomarker level analysis of the subject methods provide a statistical confidence level that a given diagnosis is correct. In some embodiments, such statistical confidence level is at least about, or more than about 85%, 90%, 91%, 92%, 93%, 94%, 95%, 96%, 97%, 98%, 99% 99.5%, or more.

In some embodiments, the method further includes classifying the sample as being FAS (+) or (−) based on the comparison of biomarker levels in the sample and reference biomarker levels, for example present in at least one training set. In some embodiments, the sample is classified as being FAS (+) or (−) if the results of the comparison meet one or more criterion such as, for example, a minimum percent agreement, a value of a statistic calculated based on the percentage agreement such as (for example) a kappa statistic, a minimum correlation (e.g., Pearson's correlation) and/or the like.

It is intended that the methods described herein can be performed by software (stored in memory and/or executed on hardware), hardware, or a combination thereof. Hardware modules may include, for example, a general-purpose processor, a field programmable gate array (FPGA), and/or an application specific integrated circuit (ASIC). Software modules (executed on hardware) can be expressed in a variety of software languages (e.g., computer code), including Unix utilities, C, C++, Java™, Ruby, SQL, SAS®, the R programming language/software environment, Visual Basic™, and other object-oriented, procedural, or other programming language and development tools. Examples of computer code include, but are not limited to, micro-code or micro-instructions, machine instructions, such as produced by a compiler, code used to produce a web service, and files containing higher-level instructions that are executed by a computer using an interpreter. Additional examples of computer code include, but are not limited to, control signals, encrypted code, and compressed code.

Some embodiments described herein relate to devices with a non-transitory computer-readable medium (also can be referred to as a non-transitory processor-readable medium or memory) having instructions or computer code thereon for performing various computer-implemented operations and/or methods disclosed herein. The computer-readable medium (or processor-readable medium) is non-transitory in the sense that it does not include transitory propagating signals per se (e.g., a propagating electromagnetic wave carrying information on a transmission medium such as space or a cable). The media and computer code (also can be referred to as code) may be those designed and constructed for the specific purpose or purposes. Examples of non-transitory computer-readable media include, but are not limited to: magnetic storage media such as hard disks, floppy disks, and magnetic tape; optical storage media such as Compact Disc/Digital Video Discs (CD/DVDs), Compact Disc-Read Only Memories (CD-ROMs), and holographic devices; magneto-optical storage media such as optical disks; carrier wave signal processing modules; and hardware devices that are specially configured to store and execute program code, such as Application-Specific Integrated Circuits (ASICs), Programmable Logic Devices (PLDs), Read-Only Memory (ROM) and Random-Access Memory (RAM) devices. Other embodiments described herein relate to a computer program product, which can include, for example, the instructions and/or computer code discussed herein.

In some embodiments, a single biomarker, or from about 5 to about 10, from about 5 to about 15, from about 5 to about 20, from about 5 to about 25, from about 5 to about 30, from about 5 to about 35, from about 5 to about 40, from about 5 to about 45, from about 5 to about 50 biomarkers, from about 5 to about 55, from about 5 to about 60, from about 5 to about 65, from about 5 to about 70, from about 5 to about 75, from about 5 to about 80, from about 5 to about 85, from about 5 to about 90, from about 5 to about 95, from about 5 to about 100 biomarkers, from about 5 to about 105, from about 5 to about 110, from about 5 to about 115, from about 5 to about 120, from about 5 to about 25 or from about 5 to about 130 biomarkers disclosed in Table 1 is/are capable of classifying an FGFR3 alteration status with a predictive success of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, a single biomarker, or from about 5 to about 10, from about 5 to about 15, from about 5 to about 20, from about 5 to about 25, from about 5 to about 30, from about 5 to about 35, from about 5 to about 40, from about 5 to about 45, from about 5 to about 50 biomarkers, from about 5 to about 55, from about 5 to about 60, from about 5 to about 65, from about 5 to about 70, from about 5 to about 75 or from about 5 to about 80 biomarkers disclosed in Table 2 is/are capable of classifying an FGFR3 alteration status with a predictive success of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, a single biomarker pair or from about 5 to about 10, from about 5 to about 15, from about 5 to about 20, from about 5 to about 25, from about 5 to about 30, from about 5 to about 35, from about 5 to about 40, from about 5 to about 45, from about 5 to about 50 biomarkers, from about 5 to about 55, from about 5 to about 60, from about 5 to about 65, from about 5 to about 70, from about 5 to about 75, from about 5 to about 80, from about 5 to about 85, from about 5 to about 90, from about 5 to about 95, from about 5 to about 100 biomarkers, from about 5 to about 105, from about 5 to about 110, or from about 5 to about 112 biomarker pairs disclosed in Table 3 is/are capable of classifying an FGFR3 alteration status with a predictive success of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, a single biomarker pair or from about 5 to about 10, from about 5 to about 15, from about 5 to about 20, from about 5 to about 25, from about 5 to about 30, from about 5 to about 35, from about 5 to about 40, from about 5 to about 45, from about 5 to about 50 biomarkers, from about 5 to about 55, from about 5 to about 60, from about 5 to about 65, from about 5 to about 70, or from about 5 to about 73 biomarker pairs disclosed in Table 4 is/are capable of classifying an FGFR3 alteration status with a predictive success of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, any combination of biomarkers disclosed herein (e.g., in Tables 1, 2, 3 and/or 4) can be used to obtain a predictive success of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, a single biomarker, or from about 5 to about 10, from about 5 to about 15, from about 5 to about 20, from about 5 to about 25, from about 5 to about 30, from about 5 to about 35, from about 5 to about 40, from about 5 to about 45, from about 5 to about 50 biomarkers, from about 5 to about 55, from about 5 to about 60, from about 5 to about 65, from about 5 to about 70, from about 5 to about 75, from about 5 to about 80, from about 5 to about 85, from about 5 to about 90, from about 5 to about 95, from about 5 to about 100 biomarkers, from about 5 to about 105, from about 5 to about 110, from about 5 to about 115, from about 5 to about 120, from about 5 to about 25 or from about 5 to about 130 biomarkers disclosed in Table 1 is/are capable of classifying an FGFR3 alteration status with a sensitivity or specificity of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, a single biomarker, or from about 5 to about 10, from about 5 to about 15, from about 5 to about 20, from about 5 to about 25, from about 5 to about 30, from about 5 to about 35, from about 5 to about 40, from about 5 to about 45, from about 5 to about 50 biomarkers, from about 5 to about 55, from about 5 to about 60, from about 5 to about 65, from about 5 to about 70, from about 5 to about 75 or from about 5 to about 80 biomarkers disclosed in Table 2 is/are capable of classifying an FGFR3 alteration status with a sensitivity or specificity of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, a single biomarker pair or from about 5 to about 10, from about 5 to about 15, from about 5 to about 20, from about 5 to about 25, from about 5 to about 30, from about 5 to about 35, from about 5 to about 40, from about 5 to about 45, from about 5 to about 50 biomarkers, from about 5 to about 55, from about 5 to about 60, from about 5 to about 65, from about 5 to about 70, from about 5 to about 75, from about 5 to about 80, from about 5 to about 85, from about 5 to about 90, from about 5 to about 95, from about 5 to about 100 biomarkers, from about 5 to about 105, from about 5 to about 110, or from about 5 to about 112 biomarker pairs disclosed in Table 3 is/are capable of classifying an FGFR3 alteration status with a sensitivity or specificity of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, a single biomarker pair or from about 5 to about 10, from about 5 to about 15, from about 5 to about 20, from about 5 to about 25, from about 5 to about 30, from about 5 to about 35, from about 5 to about 40, from about 5 to about 45, from about 5 to about 50 biomarkers, from about 5 to about 55, from about 5 to about 60, from about 5 to about 65, from about 5 to about 70, or from about 5 to about 73 biomarker pairs disclosed in Table 4 is/are capable of classifying an FGFR3 alteration status with a sensitivity or specificity of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In some embodiments, any combination of biomarkers disclosed herein (e.g., in Tables 1, 2, 3 and/or 4) can be used to obtain a sensitivity or specificity of at least about 70%, at least about 71%, at least about 72%, about 73%, about 74%, about 75%, about 76%, about 77%, about 78%, about 79%, about 80%, about 81%, about 82%, about 83%, about 84%, about 85%, about 86%, about 87%, about 88%, about 89%, about 90%, about 91%, about 92%, about 93%, about 94%, about 95%, about 96%, about 97%, about 98%, about 99%, up to 100%, and all values in between.

In one embodiment, use of either FAS-1, -2, -3 or -4 alone or in any combination thereof for predicting or ascertaining the FGFR3 mutational status of a sample obtained from a patient suffering from cancer using any of the methods provided herein can do so with predictive success greater than conducting a conventional mutational analysis (e.g., DNA mutational analysis) of said sample for any known FGFR3 oncogenic mutation. The predictive success of ascertaining the FGFR3 mutational status of a sample obtained from a patient suffering from cancer using any one of FAS-1, -2, -3 or -4 alone or in any combination thereof in a detection or diagnostic method provided herein can be at least, at most or about 5%, 10%, 15%, 20%, 25%, 30%, 35%, 40%, 45%, 50%, 55%, 60%, 65%, 70%, 75%, 85%, 90%, 91%, 92%, 93%, 94%, 95%, 96%, 97%, 98%, 99% 99.5%, or more greater than the predictive success of ascertaining the FGFR3 mutational status of a sample obtained from a patient suffering from cancer using any conventional mutational analysis (e.g., DNA mutational analysis). The predictive success of ascertaining the FGFR3 mutational status of a sample obtained from a patient suffering from cancer using any one of FAS-1, -2, -3 or -4 alone or in any combination thereof in a detection or diagnostic method provided herein can be 1, 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 99 or 100 times greater than the predictive success of ascertaining the FGFR3 mutational status of a sample obtained from a patient suffering from cancer using any conventional mutational analysis (e.g., DNA mutational analysis). The cancer can be any cancer known in the art and/or provided herein. Examples of conventional mutational analysis include but are not limited to whole exome sequencing (WES), whole genome sequencing, RNA-seq, RT-PCR, etc.

In one embodiment, use of either FAS-1, -2, -3 or -4 alone or in any combination thereof for predicting or ascertaining the FGFR3 mutational status of a sample obtained from a patient suffering from cancer using any of the methods provided herein can do so with a sensitivity greater than conducting a conventional mutational analysis (e.g., DNA mutational analysis) of said sample for any known FGFR3 oncogenic mutation. The sensitivity of ascertaining the FGFR3 mutational status of a sample obtained from a patient suffering from cancer using any one of FAS-1, -2, -3 or -4 alone or in any combination thereof in a detection or diagnostic method provided herein can be at least, at most or about 5%, 10%, 15%, 20%, 25%, 30%, 35%, 40%, 45%, 50%, 55%, 60%, 65%, 70%, 75%, 85%, 90%, 91%, 92%, 93%, 94%, 95%, 96%, 97%, 98%, 99% 99.5%, or more greater than the sensitivity of ascertaining the FGFR3 mutational status of a sample obtained from a patient suffering from cancer using any conventional mutational analysis (e.g., DNA mutational analysis). The sensitivity of ascertaining the FGFR3 mutational status of a sample obtained from a patient suffering from cancer using any one of FAS-1, -2, -3 or -4 alone or in any combination thereof in a detection or diagnostic method provided herein can be 1, 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 99 or 100 times greater than the sensitivity of ascertaining the FGFR3 mutational status of a sample obtained from a patient suffering from cancer using any conventional mutational analysis (e.g., DNA mutational analysis). The cancer can be any cancer known in the art and/or provided herein. Examples of conventional mutational analysis include but are not limited to whole exome sequencing (WES), whole genome sequencing, RNA-seq, RT-PCR, etc.

In one embodiment, use of either FAS-1, -2, -3 or -4 alone or in any combination thereof for predicting or ascertaining the FGFR3 mutational status of a sample obtained from a patient suffering from cancer using any of the methods provided herein can do so with a specificity greater than conducting a conventional mutational analysis (e.g., DNA mutational analysis) of said sample for any known FGFR3 oncogenic mutation. The specificity of ascertaining the FGFR3 mutational status of a sample obtained from a patient suffering from cancer using any one of FAS-1, -2, -3 or -4 alone or in any combination thereof in a detection or diagnostic method provided herein can be at least, at most or about 5%, 10%, 15%, 20%, 25%, 30%, 35%, 40%, 45%, 50%, 55%, 60%, 65%, 70%, 75%, 85%, 90%, 91%, 92%, 93%, 94%, 95%, 96%, 97%, 98%, 99% 99.5%, or more greater than the specificity of ascertaining the FGFR3 mutational status of a sample obtained from a patient suffering from cancer using any conventional mutational analysis (e.g., DNA mutational analysis). The specificity of ascertaining the FGFR3 mutational status of a sample obtained from a patient suffering from cancer using any one of FAS-1, -2, -3 or -4 alone or in any combination thereof in a detection or diagnostic method provided herein can be 1, 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, 99 or 100 times greater than the specificity of ascertaining the FGFR3 mutational status of a sample obtained from a patient suffering from cancer using any conventional mutational analysis (e.g., DNA mutational analysis). The cancer can be any cancer known in the art and/or provided herein. Examples of conventional mutational analysis include but are not limited to whole exome sequencing (WES), whole genome sequencing, RNA-seq, RT-PCR, etc.

Prognostic Uses

In one aspect, provided herein is a method for determining a disease outcome in a subject suffering from or suspected of suffering from cancer. The cancer can be any cancer known in the art and/or provided herein. In one embodiment, the subject is suffering from or suspected of suffering from a cancer selected from KIRP, BRCA, THCA, BLCA, PRAD, KICH, CESC, KIRC, LIHC, LGG, SARC, LUAD, COAD, UCEC, GBM, ESCA, STAD, OV or READ. The disease outcome can be a prognosis. The prognostic information that can be obtained by the methods provided herein can comprise a number of possible endpoints, which can be selected from time from surgery to distant metastases (distant recurrence-free survival), time of disease-free survival (recurrence free survival), time of progression-free survival (progression free survival) and time of overall survival. In some cases, Kaplan-Meier plots (Kaplan and Meier. J Am Stat Assoc 53: 457-481 (1958)) can be used to display time-to-event curves for any or all of these three endpoints. In some cases, a cox regression (or proportional hazards regression) can be performed in order to determine a hazard ratio for any or all of these three endpoints. In one embodiment, a cox regression (or proportional hazards regression) is used to assess the prognostic performance in terms of overall survival of an FAS (+) and/or FAS (−) sample as determined using the methods provided herein. The Cox Proportional Hazards analysis is a regression method for survival data that provides an estimate of the hazard ratio and its confidence interval. The Cox model is a well-recognized statistical technique for exploring the relationship between the survival of a subject and particular variables. This statistical method permits estimation of the hazard (i.e., risk) of individuals given their prognostic variables (e.g., FGFR3 activation status with or without other additional clinical factors, as described herein). The "hazard ratio" is the risk of death at any given time point for patients displaying particular prognostic variables. See generally Spruance et al., Antimicrob. Agents & Chemo. 48:2787-92 (2004). The additional clinical factors can include age, sex, tumor diameter, tumor stage and smoking history. A relevant time interval or time point can be at least 1 year, at least two years, at least three years, at least five years, or at least ten years.

In one embodiment, the method for determining a disease outcome for a subject suffering from or suspected of suffering from a cancer can comprise: (a) determining an FGFR3 activation signature of a sample obtained from the subject, wherein the determining the FGFR3 activation signature comprises determining the FAS of the sample obtained from the subject using any of the diagnostic or detection methods provided herein on any of the FGFR3 activation signatures (i.e., FAS 1-4) provided herein. Further to either of these embodiments, a positive FAS in the sample obtained from the subject as compared to a control sample can be indicative of a poor disease outcome for the subject. In one embodiment, a positive FAS can be indicative of poor overall survival as compared to a control sample such as a tumor sample with a negative FAS obtained from a control subject or a sample obtained from a control subject not suffering from cancer. In still another embodiment, a negative FAS in the sample obtained from the subject as compared to a control sample can be indicative of a poor disease outcome for the subject. The expression level of any and all classifier genes can be normalized as provided herein, such as, for example, normalizing expression of the classifier genes by using expression levels from one or more reference or housekeeping genes.

Therapeutic Uses

FGFR Inhibitors

In one embodiment, an agent for use in any of the diagnostic and/or therapeutic methods provided herein is an agent that shows or exhibits inhibitory activity towards a fibroblast growth factor receptor (FGFR). In one embodiment, the detection of a positive FAS in a sample obtained from a patient using any of the FGFR activation signatures provided herein (e.g., FAS 1-4) indicates that the patient is a responder to an agent that shows or exhibits inhibitory activity towards an FGFR. The agent that shows or exhibits inhibitory activity towards an FGFR can be administered to a responder (patient with a positive FAS) alone or in combination with an additional therapy or therapies. The additional therapy or therapies can be selected from the group consisting of a chemotherapeutic agent, an angiogenesis inhibitor, immunotherapy, radiotherapy, surgical intervention and any combination thereof.

The agent that shows or exhibits inhibitory activity towards an FGFR can be any agent known in the art that exhibits inhibitory activity toward fibroblast growth factor receptors generally or fibroblast growth factor receptor-3, specifically. In one embodiment, the agent is a tyrosine kinase inhibitor. The tyrosine kinase inhibitor can be any tyrosine kinase inhibitor known in the art. The tyrosine kinase inhibitor can be a selective or non-selective tyrosine kinase inhibitor. The agent can be selected from the group consisting of erdafitinib OM 42756493), infigratinib (BGJ398), Rogaritinib (BAY 1163877) AZD4547, Pemigatinib (INCB54828), TAS 20, LY2874455, DEBIO 1347, PD173074, BLU9931, pazopanib, brivanib, ponatinib (AP24534), regorafenib (BAY 73-4506), lenvatinib (E7080), dovitinib (TKI258), lucitanib (E3810), nintedanib (BIBF 1120), Foretinib, and any combination thereof. In one embodiment, the agent is nintedanib (BIBF 1120). In one embodiment, the agent is an antibody or antibody-conjugate. The antibody or antibody-conjugate can be selected from B-701, MFGR1877S and LY3076226. In one embodiment, the agent is a combination of agents that exhibit inhibitory activity toward fibroblast growth factor receptors generally or fibroblast growth factor receptor-3 specifically.

In one embodiment, the detection of a negative FAS in a sample obtained from a patient using any of the FGFR activation signatures provided herein (e.g., FAS 1-4) indicates that the patient is a non-responder to an agent that shows or exhibits inhibitory activity towards an FGFR. The agent that shows or exhibits inhibitory activity towards an FGFR can thusly, not be administered to a non-responder (patient with a negative FAS). Instead, a patient determined to be a non-responder using any of the diagnostic or detection methods provided herein (e.g., through the use of one or more FGFR3 activation signatures provided herein, i.e., FAS1-4) is administered a non-FGFR inhibitor therapy or therapies. The additional therapy or therapies can be selected from the group consisting of a chemotherapeutic agent, an angiogenesis inhibitor, immunotherapy, radiotherapy, surgical intervention and any combination thereof.

Angiogenesis Inhibitors

In one embodiment, the angiogenesis inhibitor for use in a method provided herein is a vascular endothelial growth factor (VEGF) inhibitor, a VEGF receptor inhibitor, a platelet derived growth factor (PDGF) inhibitor or a PDGF receptor inhibitor.

In one embodiment, angiogenesis inhibitor for use in a method for provided herein can include, but are not limited to an integrin antagonist, a selectin antagonist, an adhesion molecule antagonist, an antagonist of intercellular adhesion molecule (ICAM)-1, ICAM-2, ICAM-3, platelet endothelial adhesion molecule (PCAM), vascular cell adhesion molecule (VCAM)), lymphocyte function-associated antigen 1 (LFA-1), a basic fibroblast growth factor antagonist, a vascular endothelial growth factor (VEGF) modulator, a platelet derived growth factor (PDGF) modulator (e.g., a PDGF antagonist).

In one embodiment, the integrin antagonist for use in the methods provided herein can include is a small molecule integrin antagonist, for example, an antagonist described by Paolillo et al. (Mini Rev Med Chem, 2009, volume 12, pp. 1439-1446, incorporated by reference in its entirety), or a leukocyte adhesion-inducing cytokine or growth factor antagonist (e.g., tumor necrosis factor-α (TNF-α), interleukin-1β (IL-1β), monocyte chemotactic protein-1 (MCP-1) and a vascular endothelial growth factor (VEGF)), as described in U.S. Pat. No. 6,524,581, incorporated by reference in its entirety herein.

In one embodiment, the angiogenesis inhibitor for use in the methods provided herein can include interferon gamma 1β, interferon gamma 1β (Actimmune®) with pirfenidone, ACUHTR028, αVβ5, aminobenzoate potassium, amyloid P, ANG1122, ANG1170, ANG3062, ANG3281, ANG3298, ANG4011, anti-CTGF RNAi, Aplidin, *Astragalus membranaceus* extract with *salvia* and *Schisandra chinensis*, atherosclerotic plaque blocker, Azol, AZX100, BB3, connective tissue growth factor antibody, CT140, danazol, Esbriet, EXC001, EXC002, EXC003, EXC004, EXC005, F647, FG3019, Fibrocorin, Follistatin, FT011, a galectin-3 inhibitor, GKT137831, GMCT01, GMCT02, GRMD01, GRMD02, GRN510, Heberon Alfa R, interferon α-2β, ITMN520, JKB119, JKB121, JKB122, KRX168, LPA1 receptor antagonist, MGN4220, MIA2, microRNA 29a oligonucleotide, MMI0100, noscapine, PBI4050, PBI4419, PDGFR inhibitor, PF-06473871, PGN0052, Pirespa, Pirfenex, pirfenidone, plitidepsin, PRM151, Px102, PYN17, PYN22 with PYN17, Relivergen, rhPTX2 fusion protein, RXI109, secretin, STX100, TGF-β Inhibitor, transforming growth factor, β-receptor 2 oligonucleotide, VA999260, XV615 or a combination thereof.

In one embodiment, the angiogenesis inhibitor for use in the methods provided herein can include endostatin, a 20 kDa C-terminal fragment derived from type XVIII collagen, angiostatin (a 38 kDa fragment of plasmin), a member of the thrombospondin (TSP) family of proteins. In a further embodiment, the angiogenesis inhibitor for use in a method provided herein is a TSP-1, TSP-2, TSP-3, TSP-4 and TSP-5. In another embodiment, the angiogenesis inhibitor for use in the methods provided herein can include soluble VEGF receptor, e.g., soluble VEGFR-1 and neuropilin 1 (NPR1), angiopoietin-1, angiopoietin-2, vasostatin, calreticulin, platelet factor-4, a tissue inhibitor of metalloproteinase (TIMP) (e.g., TIMP1, TIMP2, TIMP3, TIMP4), cartilage-derived angiogenesis inhibitor (e.g., peptide troponin I and chrondomodulin I), a disintegrin and metalloproteinase with thrombospondin motif 1, an interferon (IFN), (e.g., IFN-α, IFN-β, IFN-γ), a chemokine, e.g., a chemokine having the C-X-C motif (e.g., CXCL10, also known as interferon gamma-induced protein 10 or small inducible cytokine B10), an interleukin cytokine (e.g., IL-4, IL-12, IL-18), prothrombin, antithrombin III fragment, prolactin, the protein encoded by the TNFSF15 gene, osteopontin, maspin, canstatin, proliferin-related protein.

In one embodiment, the angiogenesis inhibitor for use in the methods provided herein can include angiopoietin-1, angiopoietin-2, angiostatin, endostatin, vasostatin, thrombospondin, calreticulin, platelet factor-4, TIMP, CDAI, interferon α, interferon β, vascular endothelial growth factor inhibitor (VEGI) meth-1, meth-2, prolactin, VEGI, SPARC, osteopontin, maspin, canstatin, proliferin-related protein (PRP), restin, TSP-1, TSP-2, interferon gamma 1β, ACUHTR028, αVβ5, aminobenzoate potassium, amyloid P, ANG1122, ANG1170, ANG3062, ANG3281, ANG3298, ANG4011, anti-CTGF RNAi, Aplidin, *Astragalus membranaceus* extract with *salvia* and *Schisandra chinensis*, atherosclerotic plaque blocker, Azol, AZX100, BB3, connective tissue growth factor antibody, CT140, danazol, Esbriet, EXC001, EXC002, EXC003, EXC004, EXC005, F647, FG3019, Fibrocorin, Follistatin, FT011, a galectin-3 inhibitor, GKT137831, GMCT01, GMCT02, GRMD01, GRMD02, GRN510, Heberon Alfa R, interferon α-2β, ITMN520, JKB119, JKB121, JKB122, KRX168, LPA1 receptor antagonist, MGN4220, MIA2, microRNA 29a oligonucleotide, MMI0100, noscapine, PBI4050, PBI4419, PDGFR inhibitor, PF-06473871, PGN0052, Pirespa, Pirfenex, pirfenidone, plitidepsin, PRM151, Px102, PYN17, PYN22 with PYN17, Relivergen, rhPTX2 fusion protein, RXI109, secretin, STX100, TGF-β Inhibitor, transforming growth factor, β-receptor 2 oligonucleotide, VA999260, XV615 or a combination thereof.

In yet another embodiment, the angiogenesis inhibitor for use in the methods provided herein can include pazopanib (Votrient), sunitinib (Sutent), sorafenib (Nexavar), axitinib (Inlyta), ponatinib (Iclusig), vandetanib (Caprelsa), cabozantinib (Cometrig), ramucirumab (Cyramza), regorafenib (Stivarga), ziv-aflibercept (Zaltrap), motesanib, or a combination thereof. In another embodiment, the angiogenesis inhibitor is a VEGF inhibitor. In a further embodiment, the VEGF inhibitor is axitinib, cabozantinib, aflibercept, brivanib, tivozanib, ramucirumab or motesanib. In yet a further embodiment, the angiogenesis inhibitor is motesanib.

In one embodiment, an agent or additional agent for use in any of the methods provided herein can be antagonist of a member of the platelet derived growth factor (PDGF) family, for example, a drug that inhibits, reduces or modulates the signaling and/or activity of PDGF-receptors (PDGFR). For example, the PDGF antagonist, in one embodiment, is an anti-PDGF aptamer, an anti-PDGF antibody or fragment thereof, an anti-PDGFR antibody or fragment thereof, or a small molecule antagonist. In one embodiment, the PDGF antagonist is an antagonist of the PDGFR-α or PDGFR-β. In one embodiment, the PDGF antagonist is the anti-PDGF-β aptamer E10030, sunitinib, axitinib, sorefenib, imatinib, imatinib mesylate, nintedanib, pazopanib HCl, ponatinib, MK-2461, dovitinib, pazopanib, crenolanib, PP-121, telatinib, imatinib, KRN 633, CP 673451, TSU-68, Ki8751, amuvatinib, tivozanib, masitinib, motesanib diphosphate, dovitinib dilactic acid, linifanib (ABT-869).

Immunotherapy

The immunotherapy for use in the methods provided herein can be any immunotherapy provided herein. In one embodiment, the immunotherapy comprises administering one or more checkpoint inhibitors. The checkpoint inhibitors can be any checkpoint inhibitor or modulator provided herein such as, for example, a checkpoint inhibitor that targets or interacts with cytotoxic T-lymphocyte antigen 4 (CTLA4), programmed death 1 (PD-1) or its ligands (e.g., PD-L1), lymphocyte activation gene-3 (LAG3), B7 homolog 3 (B7-H3), B7 homolog 4 (B7-H4), indoleamine (2,3)-dioxygenase (IDO), adenosine A2a receptor, neuritin, B- and T-lymphocyte attenuator (BTLA), killer immunoglobulin-like receptors (KIR), T cell immunoglobulin and mucin domain-containing protein 3 (TIM-3), inducible T cell costimulator (ICOS), CD27, CD28, CD40, CD137, or combinations thereof.

In another embodiment, the immunotherapeutic agent for use in the methods provided herein is a checkpoint inhibitor. In one embodiment, the checkpoint inhibitor is a PD-1/PD-LI checkpoint inhibitor. The PD-1/PD-LI checkpoint inhibitor can be nivolumab, pembrolizumab, atezolizumab, durvalumab, lambrolizumab, or avelumab. In one embodiment, the checkpoint inhibitor is a CTLA-4 checkpoint inhibitor. The CTLA-4 checkpoint inhibitor can be ipilimumab or tremelimumab. In one embodiment, the checkpoint inhibitor is a combination of checkpoint inhibitors such as, for example, a combination of one or more PD-1/PD-LI checkpoint inhibitors used in combination with one or more CTLA-4 checkpoint inhibitors.

In one embodiment, the immunotherapeutic agent for use in the methods provided herein is a monoclonal antibody. The monoclonal antibody can be directed against tumor cells or directed against tumor products. The monoclonal antibody can be panitumumab, matuzumab, necitumunab, trastuzumab, amatuximab, bevacizumab, ramucirumab, bavituximab, patritumab, rilotumumab, cetuximab, immu-132, or demcizumab.

In yet another embodiment, the immunotherapeutic agent for use in the methods provided herein is a therapeutic vaccine. The therapeutic vaccine can be a peptide or tumor cell vaccine. The vaccine can target MAGE-3 antigens, NY-ESO-1 antigens, p53 antigens, survivin antigens, or MUC1 antigens. The therapeutic cancer vaccine can be GVAX (GM-CSF gene-transfected tumor cell vaccine), belagenpumatucel-L (allogeneic tumor cell vaccine made with four irradiated NSCLC cell lines modified with TGF-beta2 antisense plasmid), MAGE-A3 vaccine (composed of MAGE-A3 protein and adjuvant AS15), (1)-BLP-25 anti-MUC-1 (targets MUC-1 expressed on tumor cells), CimaVax EGF (vaccine composed of human recombinant Epidermal Growth Factor (EGF) conjugated to a carrier protein), WT1 peptide vaccine (composed of four Wilms' tumor suppressor gene analogue peptides), CRS-207 (live-attenuated *Listeria monocytogenes* vector encoding human mesothelin), Bec2/BCG (induces anti-GD3 antibodies), GV1001 (targets the human telomerase reverse transcriptase), TG4010 (targets the MUC1 antigen), racotumomab (anti-idiotypic antibody which mimicks the NGcGM3 ganglioside that is expressed on multiple human cancers), tecemotide (liposomal BLP25; liposome-based vaccine made from tandem repeat region of MUC1) or DRibbles (a vaccine made from nine cancer antigens plus TLR adjuvants).

In one embodiment, the immunotherapeutic agent for use in the methods provided herein is a biological response modifier. The biological response modifier can trigger inflammation such as, for example, PF-3512676 (CpG 7909) (a toll-like receptor 9 agonist), CpG-ODN 2006 (downregulates Tregs), *Bacillus* Calmette-Guerin (BCG), *Mycobacterium* vaccae (SRL172) (nonspecific immune stimulants now often tested as adjuvants). The biological response modifier can be cytokine therapy such as, for example, IL-2+ tumor necrosis factor alpha (TNF-alpha) or interferon alpha (induces T-cell proliferation), interferon gamma (induces tumor cell apoptosis), or Mda-7 (IL-24) (Mda-7/IL-24 induces tumor cell apoptosis and inhibits tumor angiogenesis). The biological response modifier can be a colony-stimulating factor such as, for example granulocyte colony-stimulating factor. The biological response modifier can be a multi-modal effector such as, for example, multi-target VEGFR: thalidomide and analogues such as lenalidomide and pomalidomide, cyclophosphamide, cyclosporine, denileukin diftitox, talactoferrin, trabecetedin or all-trans-retinmoic acid.

In one embodiment, the immunotherapy for use in the methods provided herein is cellular immunotherapy. The cellular immunotherapeutic agent can be dendritic cells (DCs) (ex vivo generated DC-vaccines loaded with tumor antigens), T-cells (ex vivo generated lymphokine-activated killer cells; cytokine-induce killer cells; activated T-cells; gamma delta T-cells), or natural killer cells.

Radiotherapy

In some embodiments, the radiotherapy can include but are not limited to proton therapy and external-beam radiation therapy. In some embodiments, the radiotherapy can include any types or forms of treatment that is suitable for patients with specific types of cancer.

In some embodiments, a patient with a specific type of cancer can have or display resistance to radiotherapy. Radiotherapy resistance in any cancer of subtype thereof can be determined by measuring or detecting the expression levels of one or more genes known in the art and/or provided herein associated with or related to the presence of radiotherapy resistance. Genes associated with radiotherapy resistance can include NFE2L2, KEAP1 and CUL3. In some embodiments, radiotherapy resistance can be associated with the alterations of KEAP1 (Kelch-like ECH-associated protein 1)/NRF2 (nuclear factor E2-related factor 2) pathway. Association of a particular gene to radiotherapy resistance can be determined by examining expression of said gene in one or more patients known to be radiotherapy non-responders and comparing expression of said gene in one or more patients known to be radiotherapy responders.

Surgical Intervention

In some embodiments, surgery approaches for use herein can include but are not limited to minimally invasive or endoscopic head and neck surgery (eHNS), Transoral Robotic Surgery (TORS), Transoral Laser Microsurgery (TLM), Endoscopic Thyroid and Neck Surgery, Robotic Thyroidectomy, Minimally Invasive Video-Assisted Thyroidectomy (MIVAT), and Endoscopic Skull Base Tumor Surgery. In some embodiments, the surgery can include any types of surgical treatment that is suitable for cancer patients. In some embodiments, the surgery can include laser technology, excision, dissection, and reconstructive surgery.

Detection Methods

In one embodiment, the methods and compositions provided herein allow for the detection of at least one biomarker or a plurality of biomarkers in a sample (e.g. tumor sample) obtained from a subject suffering from or suspected of suffering from a cancer. The at least one biomarker or plurality of classifier biomarkers can be a classifier biomarker or set of classifier biomarkers provided herein. In one embodiment, the at least one biomarker or plurality of classifier biomarkers detected using the methods and compositions provided herein are selected from Table 1 or Table 2. In one embodiment, the plurality of classifier biomarkers detected using the methods and compositions provided herein are selected from Table 1 and Table 2. In one embodiment, the methods of detecting the biomarker(s) (e.g., classifier biomarkers) in the sample (e.g., tumor sample) obtained from the subject comprises, consists essentially of, or consists of measuring the expression level of at least one or a plurality of biomarkers using any of the methods provided herein. The expression levels can be measured at the nucleic acid level or at the protein level. In one embodiment, the expression level is measured at the nucleic acid level for any method provided herein. The biomarkers can be selected from Table 1 or Table 2. In some cases, the plurality of biomarker comprises, consists essentially of or consists of only, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110, 111, 112, 113, 114, 115, 116, 117, 118, 119, 120, 121, 122, 123, 124, 125, 126, 127, 128 or 129 biomarkers of Table 1. In some cases, the plurality of biomarker comprises, consists essentially of or consists of all the biomarkers of Table 1. In some cases, the plurality of biomarker consists of only the biomarkers of Table 1. In some cases, the plurality of biomarker comprises, consists essentially of or consists of only, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, or 79 biomarkers of Table 2. In some cases, the plurality of biomarker comprises, consists essentially of or consists of all the biomarkers of Table 2. In some cases, the plurality of biomarker consists of only the biomarkers of Table 2. The detection can be by using any amplification, hybridization and/or sequencing assay disclosed herein. In some cases, the plurality of biomarker comprises, consists essentially of or consists of a subset of biomarkers of Table 1 and Table 2. In some cases, the plurality of biomarker comprises, consists essentially of or consists of all the biomarkers of Table 1 and Table 2. In some cases, the plurality of biomarker consists of only the biomarkers of Table 1 and Table 2. The detection can be by using any amplification, hybridization and/or sequencing assay disclosed herein. The cancer can be any cancer known in the art and/or provided herein. The cancer can be selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM.

In another embodiment, the methods and compositions provided herein allow for the detection of at least one biomarker or a plurality of biomarkers in a sample (e.g. tumor sample) obtained from a subject suffering from or suspected of suffering from a cancer such that the at least one biomarker is or the plurality of biomarkers are selected from the biomarkers listed in Table 1 and/or Table 2 and the detection of at least one biomarker or a plurality of biomarkers from a set of biomarkers whose presence, absence and/or level of expression is indicative of proliferation, cancer subtype, cell of origin subtype, immune activation or any combination thereof. The detection can be at the nucleic acid level. The detection can be by using any amplification, hybridization and/or sequencing assay disclosed herein.

In one embodiment, the methods and compositions provided herein allow for the detection of at least one biomarker gene pair or a plurality of biomarker gene pairs in a sample (e.g. tumor sample) obtained from a subject suffering from or suspected of suffering from a cancer. The at least one biomarker gene pair or plurality of classifier biomarker gene pairs can be a classifier biomarker gene pair or set of classifier biomarker gene pairs provided herein. In one embodiment, the at least one biomarker gene pair or plurality of classifier biomarker gene pairs detected using the methods and compositions provided herein are selected from Table 3 or Table 4. In one embodiment, the plurality of classifier biomarker gene pairs detected using the methods and compositions provided herein are selected from Table 3 and Table 4. In one embodiment, the methods of detecting the biomarker gene pair(s) in the sample (e.g., tumor sample) obtained from the subject comprises, consists essentially of, or consists of measuring the expression level of at least one or a plurality of biomarker gene pairs using any of the methods provided herein. The expression levels can be measured at the nucleic acid level or at the protein level. In one embodiment, the expression level is measured at the nucleic acid level for any method provided herein. The biomarker gene pairs can be selected from Table 3 and/or Table 4. Each gene pair selected from Table 3 comprises of a gene A and a gene B as recited in Table 3. Each gene pair selected from Table 4 comprises of a gene A and a gene B as recited in Table 4. In some cases, the plurality of biomarker gene pairs comprises, consists essentially of or consists of only, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100, 101, 102, 103, 104, 105, 106, 107, 108, 109, 110 or 111 biomarker gene pairs of Table 3. In some cases, the plurality of biomarker gene pairs comprises, consists essentially of or consists of all the biomarker gene pairs of Table 3. In some cases, the plurality of biomarker gene pairs consists of only the biomarker gene pairs of Table 3. In some cases, the plurality of biomarker gene pairs comprises, consists essentially of or consists of only, at most or at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71 or 72 biomarker gene pairs of Table 4. In some cases, the plurality of biomarker gene pairs comprises, consists essentially of or consists of all the biomarker gene pairs of Table 4. In some cases, the plurality of biomarker gene pairs consists of only the biomarker gene pairs of Table 4. In some cases, the plurality of biomarker gene pairs comprises, consists essentially of or consists of all the biomarkers of Table 3 and Table 4. In some cases, the plurality of biomarker gene pairs consists of only the biomarkers of Table 3 and Table 4. The detection can be by using any amplification, hybridization and/or sequencing assay disclosed herein. The cancer can be any cancer known in the art and/or provided herein. The cancer can be selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM.

In another embodiment, the methods and compositions provided herein allow for the detection of at least one biomarker gene pair or a plurality of biomarker gene pairs in a sample (e.g. tumor sample) obtained from a subject suffering from or suspected of suffering from a cancer such that the at least one biomarker gene pair is or the plurality of biomarker gene pairs are selected from the biomarkers listed in Table 3 and/or Table 4 and the detection of at least one biomarker or a plurality of biomarkers from a set of biomarkers whose presence, absence and/or level of expression is indicative of proliferation, cancer subtype, cell of origin subtype, immune activation or any combination thereof. The detection can be at the nucleic acid level. The detection can be by using any amplification, hybridization and/or sequencing assay disclosed herein.

In another embodiment, the methods and compositions provided herein allow for the detection of at least one biomarker or a plurality of biomarkers and at least one biomarker gene pair or a plurality of biomarker gene pairs in a sample (e.g. tumor sample) obtained from a subject suffering from or suspected of suffering from a cancer. The cancer can be any cancer known in the art and/or provided herein. The cancer can be selected from the group consisting of ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM. The at least one biomarker or the plurality of biomarkers can be selected from the biomarkers listed in Table 1 and/or Table 2. The at least one biomarker gene pair or the plurality of biomarker gene pairs can be selected from the biomarkers listed in Table 3 and/or Table 4. In some cases, the methods and compositions provided herein further comprise, consist essentially of or consist of the detection of at least one biomarker or a plurality of biomarkers from a set of biomarkers whose presence, absence and/or level of expression is indicative of proliferation, cancer subtype, cell of origin subtype, immune activation or any combination thereof. The detection can be at the nucleic acid level. The detection can be by using any amplification, hybridization and/or sequencing assay disclosed herein.

In some cases, the cancer subtyping is performed via histological analysis. The histological analysis can be performed by one or more pathologists. In some cases, the cancer subtyping is gene-expression based. The gene expression-based cancer subtyping can be determined using gene signatures known in the art for specific types of cancer. In one embodiment, the cancer is lung cancer and the gene signature is selected from the gene signatures found in WO2017/201165, WO2017/201164, US20170114416 or U.S. Pat. No. 8,822,153, each of which is herein incorporated by reference in their entirety. In one embodiment, the cancer is head and neck squamous cell carcinoma (HNSCC) and the gene signature is selected from the gene signatures found in PCT/US18/45522 or PCT/US18/48862, each of which is herein incorporated by reference in their entirety. In one embodiment, the cancer is breast cancer and the gene signature is the PAM50 subtyper found in Parker J S et al., (2009) Supervised risk predictor of breast cancer based on intrinsic subtypes. J Clin Oncol 27:1160-1167, which is herein incorporated by reference in its entirety. In one embodiment, the cancer is bladder cancer or muscle invasive bladder cancer (MIBC) and the gene signature is selected from the gene signatures found in WO2019/160914, which is herein incorporated by reference in their entirety.

In one embodiment, cell of origin subtype is determined using any method known in the art such as, for example, as provided in Hoadley et al, Cell. 2018 Apr. 5; 173(2):291-304, which is herein incorporated by reference herein. In one embodiment, the subtype is cell of origin and the gene signature is a gene signature disclosed in WO2020/076897, which is herein incorporated by reference herein.

The set of biomarkers for indicating immune activation can be gene expression signatures of Adaptive Immune Cells (AIC) and/or Innate Immune Cells (IIC) immune biomarkers, interferon genes, major histocompatibility complex, class II (MHC II) genes or a combination thereof as described in WO 2017/201165. The gene expression signatures of both IIC and AIC can be any gene signatures known in the art such as, for example, the gene signature listed in Bindea et al. (Immunity 2013; 39(4); 782-795). The detection can be at the nucleic acid level. The detection can be by using any amplification, hybridization and/or sequencing assay disclosed herein.

Kits

Kits for practicing the methods of the invention can be further provided. By "kit" can encompass any manufacture (e.g., a package or a container) comprising at least one reagent, e.g., an antibody, a nucleic acid probe or primer, etc., for specifically detecting the expression of a biomarker of the invention. The kit may be promoted, distributed, or sold as a unit for performing the methods of the present invention. Additionally, the kits may contain a package insert describing the kit and methods for its use.

In one embodiment, kits for practicing the methods of the invention are provided. Such kits are compatible with both manual and automated immunocytochemistry techniques (e.g., cell staining). In some cases, these kits comprise at least one antibody directed to a biomarker of interest, chemicals for the detection of antibody binding to the biomarker, a counterstain, and, optionally, a bluing agent to facilitate identification of positive staining cells. In some cases, these kits comprise at least one pair of antibodies directed to a biomarker pair of interest, chemicals for the detection of antibody binding to the biomarker pair, a counterstain, and, optionally, a bluing agent to facilitate identification of positive staining cells. Any chemicals that detect antigen-antibody binding may be used in the practice of the invention. The kits may comprise at least 2, at least 3, at least 4, at least 5, at least 6, at least 7, at least 8, at least 9, at least 10, or more antibodies for use in the methods of the invention.

In one embodiment, kits for practicing the methods of the invention are provided. Such kits are compatible with both manual and automated nucleic acid hybridization techniques (e.g., cell staining). In some cases, these kits comprise at least one nucleic acid probe directed to a biomarker of interest, chemicals or agents for the detection of probe binding to the biomarker, a counterstain as necessary, and, optionally, a bluing agent to facilitate identification of positive staining cells. In some cases, these kits comprise at least one pair of nucleic acid probes directed to a biomarker pair of interest, chemicals or agents for the detection of probe binding to the biomarker pair, a counterstain as necessary, and, optionally, a bluing agent to facilitate identification of positive staining cells. Any chemicals and/or agents that detect probe-target binding may be used in the practice of the invention. The kits may comprise at least 2, at least 3, at least 4, at least 5, at least 6, at least 7, at least 8, at least 9, at least 10, or more probes for use in the methods of the invention.

In one embodiment, kits for practicing the methods of the invention are provided. Such kits are compatible with both manual and automated nucleic acid amplification techniques. In some cases, these kits comprise at least one primer pair directed to a biomarker of interest, reagents for amplification of the biomarker, and, optionally, one or more sequencing primers compatible with a sequencing platform (e.g., next generation sequencing platform) for sequencing the amplified biomarker. In some cases, these kits comprise at least one pair of primers pairs directed to a biomarker pair of interest, reagents for amplification of the biomarker pair, and, optionally, one or more sequencing primers compatible with a sequencing platform (e.g., next generation sequencing platform) for sequencing the amplified biomarker gene pair. The kits may comprise at least 2, at least 3, at least 4, at least 5, at least 6, at least 7, at least 8, at least 9, at least 10, or more primer pairs for use in the methods of the invention.

EXAMPLES

The following examples are given for the purpose of illustrating various embodiments of the disclosure and are not meant to limit the present disclosure in any fashion.

Changes therein and other uses which are encompassed within the spirit of the disclosure, as defined by the scope of the claims, will be recognized by those skilled in the art.

Example 1—Development and Validation of Fibroblast Growth Factor Receptor 3 (FGFR3) Activation Signatures Using Nearest Centroid Classifiers Objective This example was initiated to address the need for an efficient method for improved patient population classification that could inform prognosis, drug response and patient management based on underlying genomic and biologic tumor characteristics. Using the dataset described in Robertson, A G, et al., Cell, 171(3): 540-556 (2017) (which is herein incorporated by reference), FGFR3 activation signatures were developed. The activation signatures developed in this example include application of an algorithm for categorization of bladder cancer samples into one of two categories-(1) FAS-positive or FAS (+) or (2) FAS negative or FAS (−) and, in some cases, evaluation of gene expression subtypes. An FAS-positive determination using an FAS developed in this example for a sample is predictive for said sample containing FGFR3 oncogenic mutation(s), while an FAS negative determination for a sample is predictive for said sample not containing FGFR3 oncogenic mutation(s). In other words, FAS (+) samples can be considered as being 'altered' with respect to FGFR3 alteration or mutation status, while FAS (−) samples can be considered as being "not altered" with respect to FGFR3 alteration or mutation status.

Materials and Methods

FAS-1: FGFR3 Activation Signature of Table 1:

To develop a first (i.e., FAS-1) clinically applicable gene signature for evaluation of the presence of FGFR3 mutations, data from a subset (i.e., two thirds (⅔); n=272) of the samples from the TCGA bladder cancer dataset that included RNA-Seq expression data (n=408 samples; gdac.broadinstitute.org/) were selected and queried for FGFR3 alteration or mutation status (i.e., queried cbioportal.org for FGFR3 mutations and fusions in selected subset of TCGA BLCA samples containing RNA-seq expression data) to obtain a subset of expression data for development of the finalized training set that contained RNA-seq expression data as well as FGFR3 alteration/mutation status. The FGFR3 alteration status of the samples in this dataset were determined as described in Robertson, A G, et al., Cell, 171(3): 540-556 (2017). With regard to alteration/mutation status, samples from the selected subset were called altered (yes) if a specific mutation or fusion in FGFR3 that was considered oncogenic (i.e., S249C, R248C, Y373C, R248C, S249C, G370C, Y373C, FGFR3-TACC3, FGFR3-BAIAP2L1) was reported. If a sample did not contain at least one of these FGFR3 mutations or fusions, then said sample was deemed to be non-altered (no).

Finalization of the training set for this FAS was done by subtyping the tumor samples within the subset selected using the 60-gene bladder subtyper and the methods for subtyping described in WO 2019/160914 (see Table 5 below, which is recreated from Table 1 in WO 2019/160914) in order to select only those samples from the subset determined to be of the luminal subtype (n=89).

Figure 2:
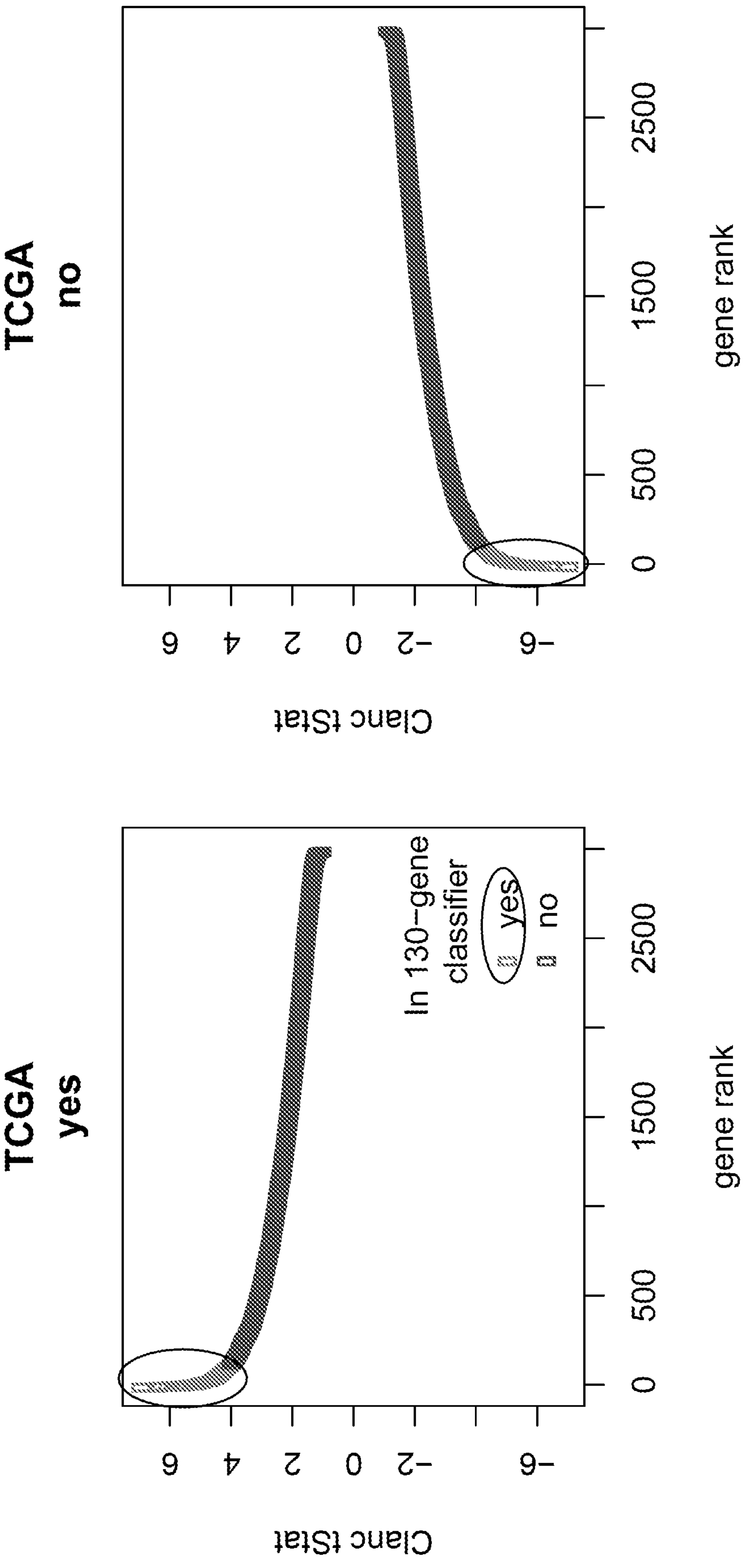
FIG. 2 illustrates Clanc tStats data used for gene selection. Shown are Clanc tStats data from the samples from TCGA bladder cancer (BLCA) dataset that make up the training set. The training set only contains samples determined to be of the luminal subtype as determined using the 60-gene subtyper and subtyping method as described in WO 2019/160914, which is herein incorporated by reference in its entirety.

Once the training set was selected, for each gene in the expression matrix (~20K genes), altered (yes) and non-altered (no) tumors were compared using a T-statistic and the top 3000 genes that were higher in altered (yes) samples were kept for feature selection. The number of genes to include in the classifier was determined using ClaNC software and 5-fold cross-validation as shown in FIG. 1. ClaNC was then run on the entire training set to determine the set of genes for the classifier as shown in FIG. 2. An ordinary nearest centroid classifier was then fit using the selected genes as described in Dabney (2005) Bioinformatics 21(22): 4148-4154. In the entire training set, each gene was centered to have median 0. Then the median of the centered values for each gene in the altered samples as well as for the non-altered samples was calculated. These values constituted the centroids. Agreement between prediction of the presence of FGFR3 mutations using the FAS in Table 1 (i.e., FAS-1) and the alteration status as determined by the methods described in Robertson, A G, et al., Cell, 171(3): 540-556 (2017) for the samples in the training set were then ascertained (see top portion of FIG. 3).

Evaluation of FAS-1 was performed by examining agreement between the prediction of the presence of FGFR3 mutations using FAS-1 and the alteration status determined for the samples in the testing set by the methods described in Robertson, A G, et al., Cell, 171(3): 540-556 (2017), which consisted of the remainder (i.e., one-third (⅓)) of the TCGA BLCA dataset not used in the training set as well as the non-luminal samples from the training set (see bottom portion of FIG. 3; n=319). Alteration status of the testing set was ascertained in the same manner as done for the training set (i.e. queried cbioportal.org for reporting specific FGFR3 mutations and fusions (S249C, R248C, Y373C, R248C, S249C, G370C, Y373C, FGFR3-TACC3, FGFR3-BAIAP2L1) for each sample in the testing set). The prediction of the presence of FGFR3 mutations in the testing set using FAS-1 was determined by examining the expression data for the genes in the FAS-1 classifier (i.e., Table 1) and subsequently applying the nearest centroid classifier to the expression data for the test set. More specifically, similarly to the training set, the testing set was subjected to subtyping using the bladder cancer subtyper disclosed in Table 1 of WO 2019/160914 (see Table 5 below for recreation of said Table) in order to determine which samples from the testing set were of the luminal subtype. Subsequently, when the FAS-1 classifier was applied to the test set, gene medians in the luminal samples from the testing set were used to center every test sample and these centered expression values were then correlated (i.e., using a Pearson correlation analysis) with each centroid in the classifier. The label of the centroid (i.e., yes or no) to which a sample was maximally correlated became the FAS call.

FAS-2: FGFR3 Activation Signature of Table 2:

To develop a second (i.e., FAS-2) clinically applicable gene signature for evaluation of the presence of FGFR3 mutations, data from a subset (i.e., two-thirds (⅔); n=272) of the samples from the TCGA bladder cancer dataset that included RNA-Seq expression data (n=408 samples; gdac.broadinstitute.org/) were selected as a training set. The FGFR3 alteration status of the samples in this dataset were determined using the methods described in Robertson, A G, et al., Cell, 171(3): 540-556 (2017). The FGFR3 alteration or mutation status of the training set was then recovered by querying cbioportal.org for FGFR3 mutations and fusions in the samples of the training set. With regard to alteration/mutation status, samples from the training set were called altered (yes) if a specific mutation or fusion in FGFR3 that was considered oncogenic (i.e., S249C, R248C, Y373C, R248C, S249C, G370C, Y373C, FGFR3-TACC3, FGFR3-BAIAP2L1) was reported. It is noted that the training set for this FAS included all BLCA subtypes and thus was not limited to samples determined to be of the luminal subtype.

Figure 4:
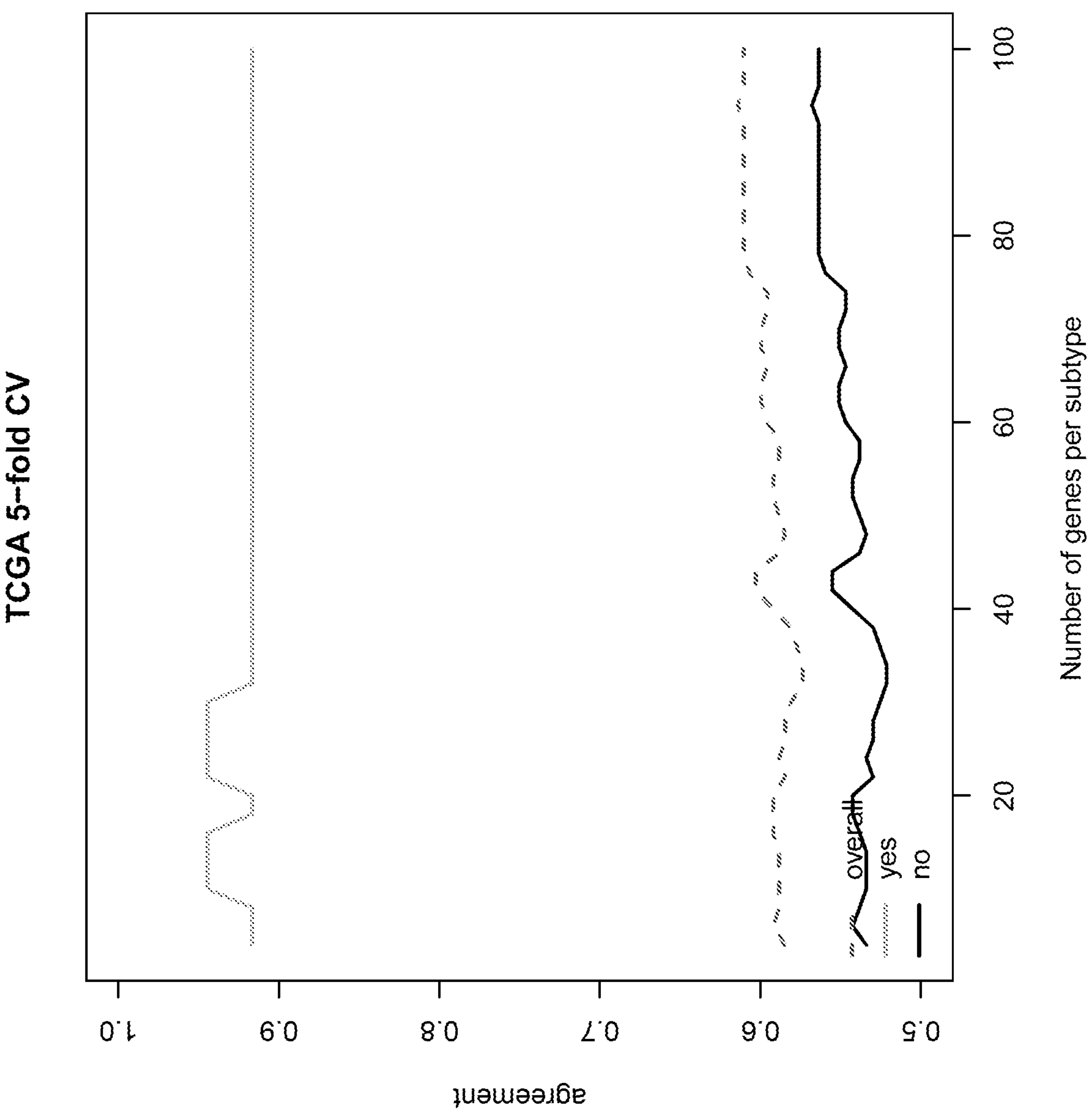
FIG. 4 illustrates five-fold cross validation curves using a Clanc plain algorithm on TCGA bladder cancer (BLCA) dataset (n=408) to guide the selection of the number of genes per FGFR3 activation signature status (i.e., positive or negative) to include in the signature of Table 2 for ascertaining FGFR3 alteration status.
Figure 5:
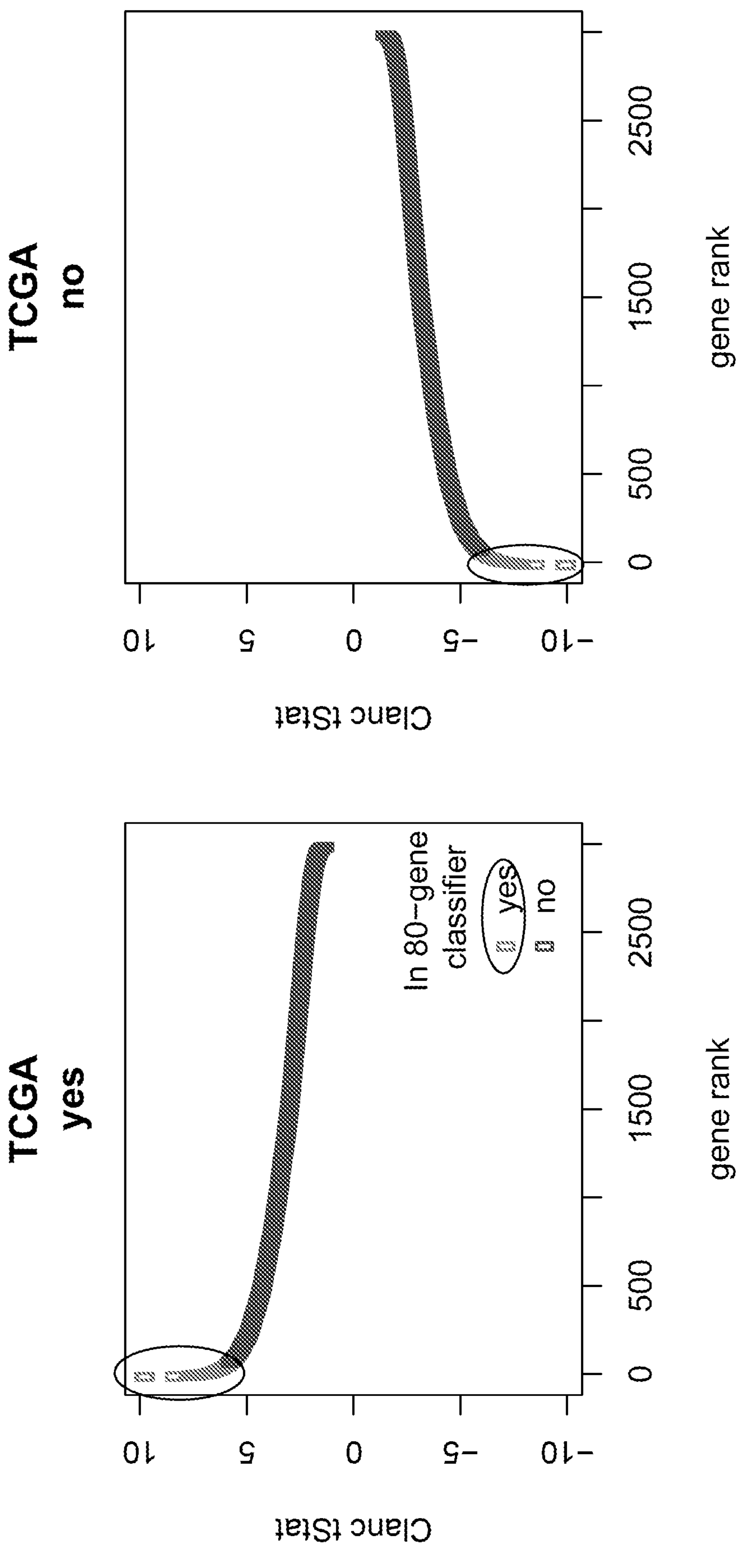
FIG. 5 illustrates Clanc tStats data used for gene selection. Shown are Clanc tStats data from the samples from TCGA bladder cancer (BLCA) dataset that make up the training set. The training set contains samples determined to be of all subtypes of BLCA as determined using the 60-gene subtyper and subtyping method as described in WO 2019/160914, which is herein incorporated by reference in its entirety.

Once the training set was selected, for each gene in the expression matrix (~20K genes), altered (yes) and non-altered (no) tumors were compared using a T-statistic and the top 3000 genes that were higher in altered (yes) samples were kept for feature selection. The number of genes to include in the classifier was determined using ClaNC software and 5-fold cross-validation as shown in FIG. 4. ClaNC was then run on the entire training set to determine the set of genes for the classifier as shown in FIG. 5. An ordinary nearest centroid classifier was then fit using the selected genes as described in Dabney (2005) Bioinformatics 21(22): 4148-4154. In the entire training set each gene was centered to have median 0. Then the median of the centered values for each gene in the altered samples as well as for the non-altered samples was calculated. These values constitute the centroids. Agreement between prediction of the presence of FGFR3 mutations using FAS-2 (Table 2) and the alteration status determined for the samples in the training set were then ascertained (see top portion of FIG. 6).

Evaluation of FAS-2 was performed by examining agreement between the prediction of the presence of FGFR3 mutations using FAS-2 and the alteration status previously determined as described in Robertson, A G, et al., Cell, 171(3): 540-556 (2017) for the samples in the testing set, which consisted of the remainder (i.e., one-third (⅓)) of the TCGA BLCA dataset not used in the training set (see bottom portion of FIG. 6; n=136). Alteration status of the testing set was recovered in the same manner as done for the training set (i.e. queried cbioportal.org for reporting specific FGFR3 mutations and fusions (S249C, R248C, Y373C, R248C, S249C, G370C, Y373C, FGFR3-TACC3, FGFR3-BAIAP2L1) for each sample in the testing set). The prediction of the presence of FGFR3 mutations in the testing set was determined by examining the expression data for the genes in the FAS-2 classifier (i.e., Table 2) and subsequently applying the nearest centroid classifier to the expression data for the test set. The overall gene medians from all the samples in the testing set were used to center the expression values for each sample in the testing set and these centered expression values were then correlated (i.e., using a Pearson correlation analysis) with each centroid in the classifier. The label of the centroid (i.e., yes or no) to which a sample was maximally correlated became the FAS call.

Results

Development of FAS-1

The 130-gene signature gene list developed in this Example is shown in Table 1. Agreement of subtype calls using the 130-gene signature with the reported mutation or alteration status in the TCGA BLCA dataset gene signature is shown in the bottom portion of FIG. 3. The newly developed 130 gene FAS demonstrated agreement of 0.84 with the determined FGFR3 alteration status of the samples from the TCGA BLCA dataset. FAS-1 will be applied to datasets from other cancers in order to assess the ability of FAS-1 to identify samples possessing FGFR3 alterations across cancer types.

Development of FAS-2

The 80-gene signature gene list developed in this Example is shown in Table 2. Agreement of subtype calls using the 80-gene signature with the reported mutation or alteration status in the TCGA BLCA dataset gene signature is shown in the bottom portion of FIG. 6. The newly developed 80 gene FAS demonstrated agreement of 0.62 with the determined FGFR3 alteration status of the samples from the TCGA BLCA dataset. FAS-2 will be applied to datasets from other cancers in order to assess the ability of FAS-2 to identify samples possessing FGFR3 alterations across cancer types.

TABLE 1

Gene Centroids of 130 Classifier Biomarkers FAS-1

| Gene Symbol | Gene Name | Yes (Positive) | No (Negative) | SEQ ID NO: | GenBank Accession Number* |
|---|---|---|---|---|---|
| ANKRD50 | Ankyrin repeat domain-containing protein 50 | 1.310205 | −0.41088 | 1 | NM_020337 |
| ANXA10 | Annexin A10 | 3.575071 | −2.58767 | 2 | NM_007193 |
| AP1M1 | Adaptor Related Protein Complex 1 Subunit Mu 1 | 0.363391 | −0.12214 | 3 | NM_001130524 |
| ARAP3 | ArfGAP With RhoGAP Domain, Ankyrin Repeat And PH Domain 3 | 0.796737 | −0.16974 | 4 | NM_022481 |
| ARHGEF10L | Rho Guanine Nucleotide Exchange Factor 10 Like | 0.415379 | −0.26463 | 5 | NM_018125 |
| B3GALNT1 | Beta-1,3-N-Acetylgalactosaminyltransferase 1 (Globoside Blood Group) | 1.024094 | −0.45073 | 6 | NM_003781 |
| B9D2 | B9 domain containing 2 | 0.329059 | −0.07397 | 7 | NM_030578 |
| BTBD16 | BTB domain containing 16 | 1.687106 | −0.51607 | 8 | NM_001318189 |
| BTF3 | basic transcription factor 3 | 0.361332 | −0.18157 | 9 | NM_001037637 |
| C16orf45 | bMERB domain containing 1 | 0.828112 | −0.71972 | 10 | NM_033201 |
| C1orf53 | chromosome 1 open reading frame 53 | 0.544773 | −0.44507 | 11 | NM_001024594 |
| CA9 | carbonic anhydrase 9 | 1.781773 | −1.16661 | 12 | NM_001216 |
| CATSPER1 | cation channel sperm associated 1 | 1.596831 | −0.67775 | 13 | NM_053054 |
| CD68 | CD68 molecule | 0.62832 | −0.36565 | 14 | NM_001251 |
| D4S234E | neuronal vesicle trafficking associated 1 | 1.84794 | −1.28593 | 15 | NM_014392 |
| DFNA5 | DFNA5, deafness associated tumor suppressor | 1.835199 | −0.71564 | 16 | NM_004403 |

TABLE 1-continued

Gene Centroids of 130 Classifier Biomarkers FAS-1

| Gene Symbol | Gene Name | Yes (Positive) | No (Negative) | SEQ ID NO: | GenBank Accession Number* |
|---|---|---|---|---|---|
| DGKA | diacylglycerol kinase alpha | 0.79683 | −0.34926 | 17 | NM_201444 |
| DISP1 | dispatched RND transporter family member 1 | 0.508231 | −0.48463 | 18 | NM_032890 |
| DOK7 | docking protein 7 | 0.775313 | −0.99243 | 19 | NM_173660 |
| DUSP7 | dual specificity phosphatase 7 | 0.702775 | −0.28964 | 20 | NM_001947 |
| EEF1A1 | eukaryotic translation elongation factor 1 alpha 1 | 0.348535 | −0.31679 | 21 | NM_001402 |
| EEF2 | eukaryotic translation elongation factor 2 | 0.425463 | −0.25144 | 22 | NM_001961 |
| EFNB1 | ephrin B 1 | 0.571048 | −0.46296 | 23 | NM_004429 |
| EPHB6 | EPH receptor B6 | 1.283645 | −0.43594 | 24 | NM_004445 |
| ERCC5 | ERCC excision repair 5, endonuclease | 0.268472 | −0.1248 | 25 | NM_000123 |
| FABP4 | fatty acid binding protein 4 | 3.952139 | −1.71183 | 26 | NM_001442 |
| FABP5 | fatty acid binding protein 5 | 0.776913 | −0.63396 | 27 | NM_001444 |
| FABP6 | fatty acid binding protein 6 | 0.964454 | −0.49024 | 28 | NM_001040442 |
| FAH | fumarylacetoacetate hydrolase | 0.637447 | −0.13861 | 29 | NM_001374377 |
| FAM155B | family with sequence similarity 155 member B | 1.56509 | −0.76954 | 30 | NM_015686 |
| FAM174B | family with sequence similarity 174 member B | 0.708107 | −0.18348 | 31 | NM_207446 |
| FGFR3 | fibroblast growth factor receptor 3 | 1.224315 | −0.58102 | 32 | NM_000142 |
| FGR | FGR proto-oncogene, Src family tyrosine kinase | 0.539843 | −0.41704 | 33 | NM_005248 |
| FSCN1 | fascin actin-bundling protein 1 | 0.498171 | −0.66168 | 34 | NM_003088 |
| GALNT13 | polypeptide N-acetylgalactosaminyltransferase 13 | 1.357861 | −1.61855 | 35 | NM_052917 |
| GAPDH | glyceraldehyde-3-phosphate dehydrogenase | 0.272858 | −0.50482 | 36 | NM_002046 |
| GDF6 | growth differentiation factor 6 | 1.319955 | −0.85751 | 37 | NM_001001557 |
| GIPC1 | GIPC PDZ domain containing family member 1 | 0.422175 | −0.19179 | 38 | NM_005716 |
| GIPR | gastric inhibitory polypeptide receptor | 1.548827 | −0.66197 | 39 | NM_000164 |
| GKN1 | gastrokine 1 | 2.387615 | −0.61892 | 40 | NM_019617 |
| GLTSCR2 | glioma tumor suppressor candidate region gene 2 | 0.69078 | −0.16491 | 41 | AF182076 |
| GNA15 | G protein subunit alpha 15 | 0.508394 | −0.24606 | 42 | NM_002068 |
| GNB2L1 | Guanine nucleotide-binding protein subunit beta-2-like 1 | 0.795403 | −0.14594 | 43 | CR456978 |
| GOLGA7B | golgin A7 family member B | 1.543892 | −0.61086 | 44 | NM_001010917 |
| HAS3 | hyaluronan synthase 3 | 0.458599 | −1.0425 | 45 | NM_005329 |
| HDAC7 | histone deacetylase 7 | 0.287603 | −0.17076 | 46 | NM_015401 |
| HOXB2 | homeobox B2 | 1.567314 | −0.92885 | 47 | NM_002145 |
| HOXB3 | homeobox B3 | 1.655644 | −0.32771 | 48 | NM_002146 |
| HOXB4 | homeobox B4 | 1.108104 | −0.22283 | 49 | NM_024015 |
| HOXB6 | homeobox B6 | 1.686506 | −0.29389 | 50 | NM_018952 |
| HOXD1 | homeobox D1 | 1.859057 | −0.30072 | 51 | NM_024501 |
| HOXD3 | homeobox D3 | 0.959143 | −0.14001 | 52 | NM_006898 |
| HOXD4 | homeobox D4 | 1.057809 | −0.36098 | 53 | NM_014621 |
| HSD17B2 | hydroxysteroid 17-beta dehydrogenase 2 | 1.106698 | −0.74296 | 54 | NM_002153 |
| HTR7 | 5-hydroxytryptamine receptor 7 | 2.383204 | −1.27058 | 55 | NM_000872 |
| IGFBP4 | insulin like growth factor binding protein 4 | 0.642015 | −0.31827 | 56 | NM_001552 |
| ITGA3 | integrin subunit alpha 3 | 0.938921 | −0.22026 | 57 | NM_002204 |
| LAD1 | ladinin 1 | 0.80386 | −0.27975 | 58 | NM_005558 |
| LDHB | lactate dehydrogenase B | 0.505825 | −0.26863 | 59 | NM_001315537 |
| LPAL2 | lipoprotein(a) like 2, pseudogene | 0.910606 | −0.32926 | 60 | NR_028092 |
| LPA | lipoprote in(a) | 2.09647 | −1.56489 | 61 | NM_005577 |
| LY6D | lymphocyte antigen 6 family member D | 4.313145 | −1.72633 | 62 | NM_003695 |
| MAN2C1 | mannosidase alpha class 2C member 1 | 0.660794 | −0.15049 | 63 | NM_006715 |
| MARK4 | microtubule affinity regulating kinase 4 | 0.283622 | −0.08118 | 64 | NM_001199867 |
| MBOAT7 | membrane bound O-acyltransferase domain containing 7 | 0.44465 | −0.37984 | 65 | NM_024298 |
| MCTP2 | multiple C2 and transmembrane domain containing 2 | 0.916844 | −0.40525 | 66 | NM_018349 |

TABLE 1-continued

Gene Centroids of 130 Classifier Biomarkers FAS-1

| Gene Symbol | Gene Name | Yes (Positive) | No (Negative) | SEQ ID NO: | GenBank Accession Number* |
|---|---|---|---|---|---|
| MDFI | MyoD family inhibitor | 0.971461 | −0.54817 | 67 | NM_001300804 |
| MTFMT | mitochondrial methionyl-tRNA formyltransferase | 0.268741 | −0.09061 | 68 | NM_139242 |
| NACA | nascent polypeptide associated complex subunit alpha | 0.515099 | −0.16423 | 69 | NM_001113203 |
| NCKAP5 | NCK associated protein 5 | 1.226181 | −0.55608 | 70 | NM_207363 |
| NDUFA4L2 | NDUFA4 mitochondrial complex associated like 2 | 1.892784 | −0.94873 | 71 | NM_020142 |
| NLRP1 | NLR family pyrin domain containing 1 | 1.374396 | −0.65306 | 72 | NM_033004 |
| NXF3 | nuclear RNA export factor 3 | 1.211858 | −0.14067 | 73 | NM_022052 |
| ORAI3 | ORAI calcium release-activated calcium modulator 3 | 0.623602 | −0.28801 | 74 | NM_152288 |
| PCDHGC3 | protocadherin gamma subfamily C, 3 | 0.506974 | −0.2797 | 75 | NM_002588 |
| PLAG1 | PLAG1 zinc finger | 1.250628 | −0.92529 | 76 | NM_002655 |
| PLCD3 | phospholipase C delta 3 | 0.785603 | −0.60483 | 77 | NM_133373 |
| PLCH2 | phospholipase C eta 2 | 1.469721 | −0.2776 | 78 | NM_014638 |
| PLEKHG5 | pleckstrin homology and RhoGEF domain containing G5 | 0.617835 | −0.23963 | 79 | NM_020631 |
| PLEKHH3 | pleckstrin homology domain containing, family H (with MyTH4 domain) member 3 | 0.442032 | −0.31329 | 80 | NM_024927 |
| PLXNB3 | plexin B3 | 0.873017 | −0.92864 | 81 | NM_005393 |
| PSD4 | pleckstrin and Sec7 domain containing 4 | 0.587232 | −0.23275 | 82 | NM_012455 |
| RNF126 | ring finger protein 126 | 0.551428 | −0.18502 | 83 | NM_194460 |
| RPL10A | ribosomal protein L10a | 0.520232 | −0.24828 | 84 | NM_007104 |
| RPL10 | ribosomal protein L10 | 0.434698 | −0.28525 | 85 | NM_006013 |
| RPL13A | ribosomal protein L13a | 0.402825 | −0.14554 | 86 | NM_01043 |
| RPL3 | ribosomal protein L3 | 0.52104 | −0.31417 | 87 | NM_000967 |
| RPL4 | ribosomal protein L4 | 0.623492 | −0.31222 | 88 | NM_000968 |
| RPS2 | ribosomal protein S2 | 0.723923 | −0.29777 | 89 | NM_002952 |
| SAMD4A | sterile alpha motif domain containing 4A | 1.022212 | −0.3149 | 90 | NM_015589 |
| SEMA4B | semaphorin 4B | 0.787447 | −0.61669 | 91 | NM_020210 |
| SH2D3A | SH2 domain containing 3A | 0.581835 | −0.21855 | 92 | NM_005490 |
| SH3BP1 | SH3 domain binding protein 1 | 0.520415 | −0.18077 | 93 | NM_018957 |
| SH3PXD2A | SH3 and PX domains 2A | 0.659154 | −0.2364 | 94 | NM_014631 |
| SLC25A12 | solute carrier family 25 member 12 | 0.431546 | −0.24743 | 95 | NM_003705 |
| SLIT3 | slit guidance ligand 3 | 1.169082 | −0.8078 | 96 | NM_001271946 |
| SLITRK6 | SLIT and NTRK like family member 6 | 0.786343 | −0.57273 | 97 | NM_032229 |
| SLURP1 | secreted LY6/PLAUR domain containing 1 | 1.79573 | −0.69869 | 98 | NM_020427 |
| SMAD3 | SMAD family member 3 | 0.685369 | −0.28751 | 99 | NM_005902 |
| SNX1 | sorting nexin 1 | 0.37966 | −0.13032 | 100 | NM_003099 |
| SOX15 | SRY-box transcription factor 15 | 1.505338 | −1.07778 | 101 | NM_006942 |
| SPATA20 | spermatogenesis associated 20 | 0.380705 | −0.21086 | 102 | NM_022827 |
| SPOCD1 | SPOC domain containing 1 | 1.896285 | −1.53166 | 103 | NM_144569 |
| SPRED1 | sprouty related EVH1 domain containing 1 | 0.668493 | −0.52368 | 104 | NM_152594 |
| SSH3 | slingshot protein phosphatase 3 | 0.685906 | −0.13245 | 105 | NM_017857 |
| STX18 | syntaxin 18 | 0.230505 | −0.07479 | 106 | NM_016930 |
| SYT9 | synaptotagmin 9 | 1.673251 | −0.51544 | 107 | NM_175733 |
| SYTL1 | synaptotagmin like 1 | 0.98739 | −0.21323 | 108 | NM_001193308 |
| TFBIM | transcription factor B1, mitochondrial | 0.345579 | −0.20994 | 109 | NM_016020 |
| TFEB | transcription factor EB | 0.931108 | −0.44473 | 110 | NM_007162 |
| TFF1 | trefoil factor 1 | 2.654384 | −0.89921 | ill | NM_003225 |
| THAP4 | THAP domain containing 4 | 0.658066 | −0.16187 | 112 | NM_015963 |
| TMBIM4 | transmembrane BAX inhibitor motif containing 4 | 0.35737 | −0.16806 | 113 | NM_001282606 |
| TMC4 | transmembrane channel like 4 | 0.397023 | −0.31704 | 114 | NM_001145303 |
| TMPRSS4 | transmembrane serine protease 4 | 1.096763 | −0.95141 | 115 | NM_019894 |
| TPT1 | tumor protein, translationally-controlled 1 | 0.693244 | −0.1689 | 116 | NM_001286272 |
| TRAPPC1 | trafficking protein particle complex 1 | 0.449747 | −0.16887 | 117 | NM_021210 |
| TRIM7 | tripartite motif containing 7 | 0.82171 | −0.82282 | 118 | NM_203293 |
| TRIOBP | TRIO and F-actin binding protein | 0.441197 | −0.1103 | 119 | NM_007032 |

TABLE 1-continued

Gene Centroids of 130 Classifier Biomarkers FAS-1

| Gene Symbol | Gene Name | Yes (Positive) | No (Negative) | SEQ ID NO: | GenBank Accession Number* |
|---|---|---|---|---|---|
| TSPO | translocator protein | 0.493752 | −0.15125 | 120 | NM_001256530 |
| TUBG2 | tubulin gamma 2 | 0.878745 | −0.53413 | 121 | NM_001320509 |
| UBXN6 | UBX domain protein 6 | 0.241758 | −0.10087 | 122 | NM_025241 |
| VASP | vasodilator stimulated phosphoprotein | 0.519976 | −0.29792 | 123 | NM_003370 |
| WIF1 | WNT inhibitory factor 1 | 1.737917 | −0.35322 | 124 | NM_007191 |
| WNT7B | Wnt family member 7B | 0.959892 | −0.3564 | 125 | NM_058238 |
| ZBTB7A | zinc finger and BTB domain containing 7A | 0.303057 | −0.18878 | 126 | NM_015898 |
| ZNF385A | zinc finger protein 385A | 0.721817 | −0.28908 | 127 | NM_001130967 |
| ZNF446 | zinc finger protein 446 | 0.415659 | −0.14118 | 128 | NM_017908 |
| ZNF608 | zinc finger protein 608 | 1.016461 | −0.56393 | 129 | NM_020747 |
| ZNF792 | zinc finger protein 792 | 0.28399 | −0.26532 | 130 | NM_175872 |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

TABLE 2

Gene Centroids of 80 Classifier Biomarkers FAS-2

| Gene Symbol | Gene Name | Yes (Positive) | No (Negative) | SEQ ID NO: | GenBank Accession Number* |
|---|---|---|---|---|---|
| ACIN1 | apoptotic chromatin condensation inducer 1 | 0.358409 | −0.05321 | 131 | NM_014977 |
| ACY1 | aminoacylase 1 | 0.941008 | −0.09402 | 132 | NM_000666 |
| AES | TLE family member 5, transcriptional modulator | 0.77711 | −0.089 | 133 | NM_198969 |
| ANKRD50 | Ankyrin repeat domain-containing protein 50 | 1.513726 | −0.20257 | 1 | NM_020337 |
| ANXA10 | Annexin A10 | 8.103391 | −1.44523 | 2 | NM_007193 |
| AP1G2 | adaptor related protein complex 1 subunit gamma 2 | 0.917423 | −0.11857 | 134 | NM_003917 |
| APOL1 | apolipoprotein L1 | 1.537247 | −0.20891 | 135 | NM_003661 |
| ARHGEF10L | Rho Guanine Nucleotide Exchange Factor 10 Like | 0.848374 | −0.14319 | 5 | NM_018125 |
| BTBD16 | BTB domain containing 16 | 4.623299 | −0.76908 | 8 | NM_001318189 |
| C2orf66 | chromosome 2 open reading frame 66 | 1.89484 | −0.25061 | 136 | NM_213608 |
| CBR4 | carbonyl reductase 4 | 0.822247 | −0.10275 | 137 | NM_032783 |
| CLCA4 | chloride channel accessory 4 | 5.171315 | −0.75899 | 138 | NM_012128 |
| CLK1 | CDC like kinase 1 | 0.82459 | −0.03755 | 139 | NM_004071 |
| CYP3A5 | cytochrome P450 family 3 subfamily A member 5 | 2.849838 | −0.61958 | 140 | NM_000777 |
| D4S234E | neuronal vesicle trafficking associated 1 | 3.341414 | −0.4205 | 141 | NM_001382227 |
| DGKA | diacylglycerol kinase alpha | 1.182783 | −0.1395 | 17 | NM_201444 |
| DGKQ | diacylglycerol kinase theta | 0.690897 | −0.05801 | 142 | NM_001347 |
| DHRS3 | dehydrogenase/reductase 3 | 1.311883 | −0.11219 | 143 | NM_004753 |
| EPHB6 | EPH receptor B6 | 2.137016 | −0.26723 | 24 | NM_004445 |
| FABP6 | fatty acid binding protein 6 | 2.58289 | −0.42514 | 28 | NM_001040442 |
| FAM155B | family with sequence similarity 155 member B | 2.745942 | −0.5682 | 30 | NM_015686 |
| FGFR3 | fibroblast growth factor receptor 3 | 2.337295 | −0.37048 | 32 | NM_000142 |
| GIPC1 | GIPC PDZ domain containing family member 1 | 0.717536 | −0.06649 | 38 | NM_005716 |
| GIPR | gastric inhibitory polypeptide receptor | 2.063667 | −0.17915 | 39 | NM_000164 |
| GPR108 | G protein-coupled receptor 108 | 0.412662 | −0.05431 | 144 | NM_001080452 |
| HDAC10 | histone deacetylase 10 | 0.775232 | −0.08293 | 145 | NM_032019 |
| HOXB3 | homeobox B3 | 1.715807 | −0.14804 | 48 | NM_002146 |
| HOXB4 | homeobox B4 | 1.137447 | −0.12047 | 49 | NM_024015 |

TABLE 2-continued

| Gene Centroids of 80 Classifier Biomarkers FAS-2 | | | | | |
|---|---|---|---|---|---|
| Gene Symbol | Gene Name | Yes (Positive) | No (Negative) | SEQ ID NO: | GenBank Accession Number* |
| HOXB6 | homeobox B6 | 2.09901 | −0.16808 | 50 | NM_018952 |
| HOXD4 | homeobox D4 | 1.476906 | −0.41644 | 53 | NM_014621 |
| JMJD7-PLA2G4B | JMJD7-PLA2G4B readthrough | 1.103109 | −0.13542 | 146 | NM_005090 |
| KRTAP5-10 | keratin associated protein 5-10 | 2.341197 | −0.29369 | 147 | NM_001012710 |
| LDB1 | LIM domain binding 1 | 0.726826 | −0.07894 | 148 | NM_001113407 |
| LPA | lipoprote in(a) | 3.7719 | −0.25084 | 61 | NM_005577 |
| LPCAT4 | lysophosphatidylcholine acyltransferase 4 | 0.789448 | −0.11518 | 149 | NM_153613 |
| LUC7L | LUC7 like | 1.04196 | −0.04421 | 150 | NM_018032 |
| MAN2C1 | mannosidase alpha class 2C member 1 | 0.771118 | −0.06164 | 63 | NM_006715 |
| MBD6 | methyl-CpG binding domain protein 6 | 0.576527 | −0.09416 | 151 | NM_052897 |
| MGST2 | microsomal glutathione S-transferase 2 | 1.008206 | −0.10578 | 152 | NM_002413 |
| MKNK2 | MAPK interacting serine/threonine kinase 2 | 0.641748 | −0.0691 | 153 | NM_017572 |
| MMEL1 | membrane metalloendopeptidase like 1 | 1.836637 | −0.43644 | 154 | NM_033467 |
| NADSYN1 | NAD synthetase 1 | 1.390908 | −0.1139 | 155 | NM_018161 |
| NDUFA4L2 | NDUFA4 mitochondrial complex associated like 2 | 2.645136 | −0.26997 | 71 | NM_020142 |
| NXF3 | nuclear RNA export factor 3 | 1.180731 | −0.11054 | 73 | NM_022052 |
| OR9K2 | olfactory receptor family 9 subfamily K member 2 | 0.52954 | 0 | 156 | NM_001005243 |
| PICK1 | protein interacting with PRKCA 1 | 0.436424 | −0.08281 | 157 | NM_012407 |
| PIK3R2 | phosphoinositide-3-kinase regulatory subunit 2 | 0.42071 | −0.0378 | 158 | NM_005027 |
| PLCD3 | phospholipase C delta 3 | 1.846704 | −0.17516 | 77 | NM_133373 |
| PLEKHH3 | pleckstrin homology domain containing, family H (with MyTH4 domain) member 3 | 0.949314 | −0.10182 | 80 | NM_024927 |
| PLXNB3 | plexin B3 | 1.972023 | −0.28414 | 81 | NM_005393 |
| PRPF40B | pre-mRNA processing factor 40 homolog B | 0.632749 | −0.15179 | 159 | NM_001031698 |
| RAI1 | retinoic acid induced 1 | 0.822948 | −0.09976 | 160 | NM_030665 |
| RHOT2 | ras homolog family member T2 | 0.649593 | −0.06661 | 161 | NM_001352275 |
| SEMA4B | semaphorin 4B | 1.448931 | −0.19908 | 91 | NM_020210 |
| SH3BP1 | SH3 domain binding protein 1 | 0.995395 | −0.18725 | 93 | NM_018957 |
| SMAD3 | SMAD family member 3 | 1.274757 | −0.14046 | 99 | NM_005902 |
| SNX1 | sorting nexin 1 | 0.522427 | −0.0575 | 100 | NM_003099 |
| SOX15 | SRY-box transcription factor 15 | 3.183053 | −1.10652 | 101 | NM_006942 |
| SPATA20 | spermatogenesis associated 20 | 0.838735 | −0.12721 | 102 | NM_022827 |
| SPDEF | SAM pointed domain containing ETS transcription factor | 2.960365 | −0.31279 | 162 | NM_012391 |
| SPOCD1 | SPOC domain containing 1 | 3.671152 | −0.16795 | 103 | NM_144569 |
| SSH3 | slingshot protein phosphatase 3 | 1.258471 | −0.16232 | 105 | NM_017857 |
| SYTL1 | synaptotagmin like 1 | 1.577584 | −0.21395 | 108 | NM_001193308 |
| TADA2B | transcriptional adaptor 2B | 0.448892 | −0.04279 | 163 | NM_152293 |
| TFF1 | trefoil factor 1 | 4.498955 | −0.73371 | 111 | NM_003225 |
| TMBIM4 | transmembrane BAX inhibitor motif containing 4 | 0.50692 | −0.07733 | 113 | NM_001282606 |
| TMPRSS4 | transmembrane serine protease 4 | 2.497629 | −0.36615 | 115 | NM_019894 |
| TOLLIP | toll interacting protein | 0.657194 | −0.07288 | 164 | NM_019009 |
| TRABD | TraB domain containing | 0.639093 | −0.0824 | 165 | NM_001320484 |
| TRIOBP | TRIO and F-actin binding protein | 0.860818 | −0.10536 | 119 | NM_007032 |
| TSPAN14 | tetraspanin 14 | 0.71371 | −0.15245 | 166 | NM_030927 |
| TSPO | translocator protein | 0.850086 | −0.06516 | 120 | NM_001256530 |
| TUBG2 | tubulin gamma 2 | 0.982313 | −0.09705 | 121 | NM_001320509 |
| TUBGCP6 | tubulin gamma complex associated protein 6 | 0.531993 | −0.09619 | 167 | NM_020461 |

TABLE 2-continued

Gene Centroids of 80 Classifier Biomarkers FAS-2

| Gene Symbol | Gene Name | Yes (Positive) | No (Negative) | SEQ ID NO: | GenBank Accession Number* |
|---|---|---|---|---|---|
| TXNDC17 | thioredoxin domain containing 17 | 0.597635 | −0.08418 | 168 | NM_032731 |
| UGT2B28 | UDP glucuronosyltransferase family 2 member B28 | 2.616392 | −0.51813 | 169 | NM_053039 |
| WNT7B | Wnt family member 7B | 1.485116 | −0.16525 | 125 | NM_058238 |
| ZBTB7A | zinc finger and BTB domain containing 7A | 0.640245 | −0.04167 | 126 | NM_015898 |
| ZNF385A | zinc finger protein 385A | 1.312213 | −0.08652 | 127 | NM_001130967 |
| ZNF692 | zinc finger protein 692 | 1.03149 | −0.14106 | 170 | NM_001136036 |

Example 2—Development and Validation of Fibroblast Growth Factor Receptor 3 (FGFR3) Activation Signatures Using k-Top Scoring Pairs (kTSP) Classifiers Objective Again, using the dataset described in Robertson, A G, et al., Cell, 171(3): 540-556 (2017) (which is herein incorporated by reference), FGFR3 activation signatures were developed using a rank based classifier (i.e., k-top scoring pairs (kTSP)) that depends only on the relative ranks of the expression of genes within a sample, allowing such classifiers to be robust against platform-specific effects and study-to-study variations due to data normalization and preprocessing. Like the signatures developed in Example 1, the activation signatures developed in this example include application of an algorithm for categorization of bladder cancer samples into one of two categories-(1) FAS-positive or FAS (+) or (2) FAS negative or FAS (−), and, in some cases, evaluation of gene expression subtypes. An FAS-positive determination using an FAS developed in this example for a sample is predictive for said sample containing FGFR3 oncogenic mutation(s), while an FAS negative determination for a sample is predictive for said sample not containing FGFR3 oncogenic mutation(s). In general, the kTSP approach can be used to select k pairs of genes A and B such that gene A expression >gene B expression implies sample membership to class 1 (i.e., FAS (+)), otherwise implying membership to class 2 (i.e., FAS (−)). Like for Example 1, FAS (+) samples can be considered as being 'altered' with respect to FGFR3 alteration or mutation status, while FAS (−) samples can be considered as being "not altered" with respect to FGFR3 alteration or mutation status.

Materials and Methods

FAS-3: FGFR3 Activation Signature of Table 3:

To develop a third clinically applicable gene signature for evaluation of the presence of FGFR3 mutations in a sample, data from a subset (i.e., two thirds (⅔); n=272) of the samples from the TCGA bladder cancer dataset that included RNA-Seq expression data (n=408 samples; gdac.broadinstitute.org/) were selected and queried for FGFR3 alteration or mutation status (i.e., queried cbioportal.org for FGFR3 mutations and fusions in selected subset of TCGA BLCA samples containing RNA-seq expression data) to obtain a subset of expression data for development of the finalized training set that contained RNA-seq expression data as well as FGFR3 alteration/mutation status. The FGFR3 alteration status of the samples in this dataset were determined using the methods described in Robertson, A G, et al., Cell, 171(3): 540-556 (2017). With regard to alteration/mutation status, samples from the selected subset were called altered (yes) if a specific mutation or fusion in FGFR3 that was considered oncogenic (i.e., S249C, R248C, Y373C, R248C, S249C, G370C, Y373C, FGFR3-TACC3, FGFR3-BAIAP2L1) was reported. If a sample did not contain at least one of these FGFR3 mutations or fusions, then said sample was deemed to be non-altered (no).

Finalization of the training set was performed by subtyping the tumor samples within the subset selected using the 60-gene bladder cancer subtyper and the methods for subtyping described in WO 2019/160914 (see Table 5 below, which is recreated from Table 1 in WO 2019/160914) in order to select only those samples from the subset determined to be of the luminal subtype (n=89).

Figure 7:
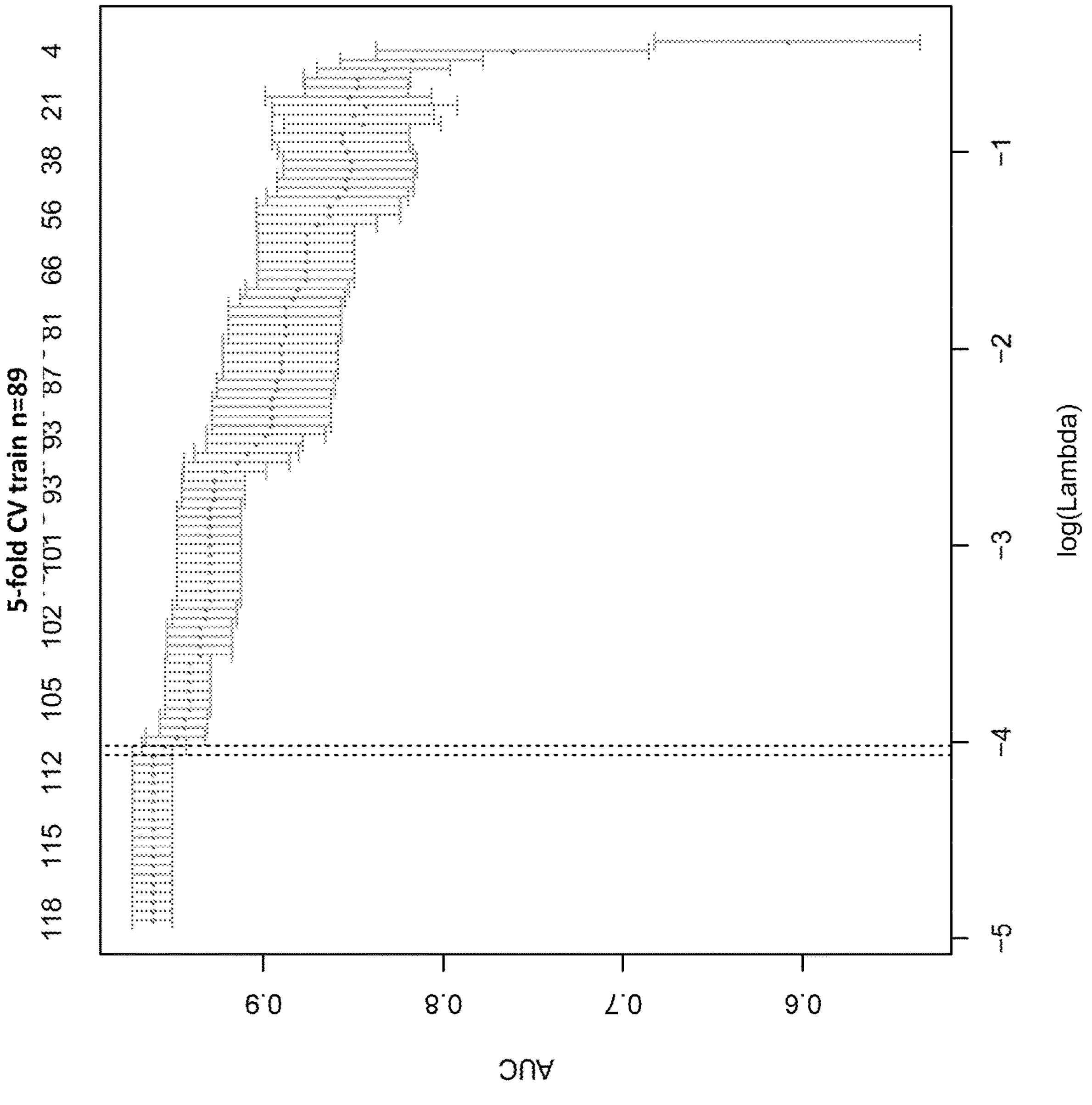
FIG. 7 illustrates the cross-validation curves used to determine the number of features (i.e., gene pairs) to include in the kTSP classifier when the training data included luminal tumors only. 112 gene pairs were chosen in order to obtain the most parsimonious model within one standard deviation of the number of pairs that provided the best model performance as measured by area under the curve.

Once the training set was selected, feature selection was performed by first identifying approximately 1000 (here 1207) highly variable, highly expressed genes. For every possible gene pair chosen from the set of 1207, the proportion of FGFR3 altered samples having the first gene expression value larger than that for the second gene was calculated, and the same proportion was calculated in the FGFR3 wild-type (i.e., not altered) samples. The absolute difference in proportions was recorded for each gene pair. All gene pairs having an absolute difference greater than 0.5 (i.e., 3844 pairs) were chosen for feature selection using the glmnet software (www.jstatsoft.org/article/view/v033i01) package implemented in R. Glmnet was used with an elastic net mixing parameter of 0.5 to fit a logistic regression model, where FGFR3 alteration status was the binary dependent variable and indicator variables for each gene pair taking values of one when expression for the first gene in the pair was higher than the second and zero otherwise were the independent variables. From here, a five (5)-fold cross-validation was performed (see FIG. 7) resulting in 112 top-scoring pairs (TSPs) being selected and the final model was then fit using the entire training set (Table 3). Once generated, FAS-3 was applied to the training set in order to ascertain the FGFR3 alteration status for each sample in the set. In particular, to classify each sample in the training set, gene expression from the pairs of genes in Table 3 (i.e., FAS-3) below were compared such that for each gene pair, if Gene A expression was greater than Gene B expression, the coefficient for that gene pair was added to a running sum. If the sum of all such coefficients and the intercept from Table 3 below was greater than zero, the sample was classified as altered (i.e., possessing FGFR3 alteration(s)) (see EQUATION 1). The actual value of d from Equation 1 below represented the score for any particular sample.

For each gene pair in Table 3 below, if $A_i$ and $B_i$ are the measured expression of Genes A and B of Table 3 in the $i^{th}$ row, $C_i$ is the $i^{th}$ coefficient, and I is the intercept, then a score was calculated as follows:

$$d = I + \sum_i P_i C_i \quad \text{EQUATION 1}$$

Subsequently, FAS-3 was applied to the testing set (n=319), which consisted of the remainder of the TCGA BLCA dataset not used in the training set as well as the non-luminal samples from the training set in order to ascertain the FGFR3 alteration status for each sample in the set. In particular, as for the training set, for each sample in the testing set, the expression levels of Genes A and B in each pair from Table 3 were input into Equation 1 in order to determine if said sample was altered (FGFR3 alteration status of 'Yes') or not altered (FGFR3 alteration status of 'No').

FAS-4: FGFR3 Activation Signature of Table 4:

To develop a fourth (i.e., FAS-4) clinically applicable gene signature for evaluation of the presence of FGFR3 mutations, data from a subset (i.e., two-thirds (⅔); n=272) of the samples from the TCGA bladder cancer dataset that included RNA-Seq expression data (n=408 samples; gdac-.broadinstitute.org/) were selected as a training set. The FGFR3 alteration or mutation status of the training set was then determined by querying cbioportal.org for FGFR3 mutations and fusions in the samples of the training set. The FGFR3 alteration status of the samples in this dataset were determined using the methods described in Robertson, A G, et al., Cell, 171(3): 540-556 (2017). With regard to alteration/mutation status, samples from the training set were called altered (yes) if a specific mutation or fusion in FGFR3 that was considered oncogenic (i.e., S249C, R248C, Y373C, R248C, S249C, G370C, Y373C, FGFR3-TACC3, FGFR3-BAIAP2L1) was reported. It is noted that the training set for this FAS included all BLCA subtypes and thus was not limited to samples determined to be of the luminal subtype.

Figure 10:
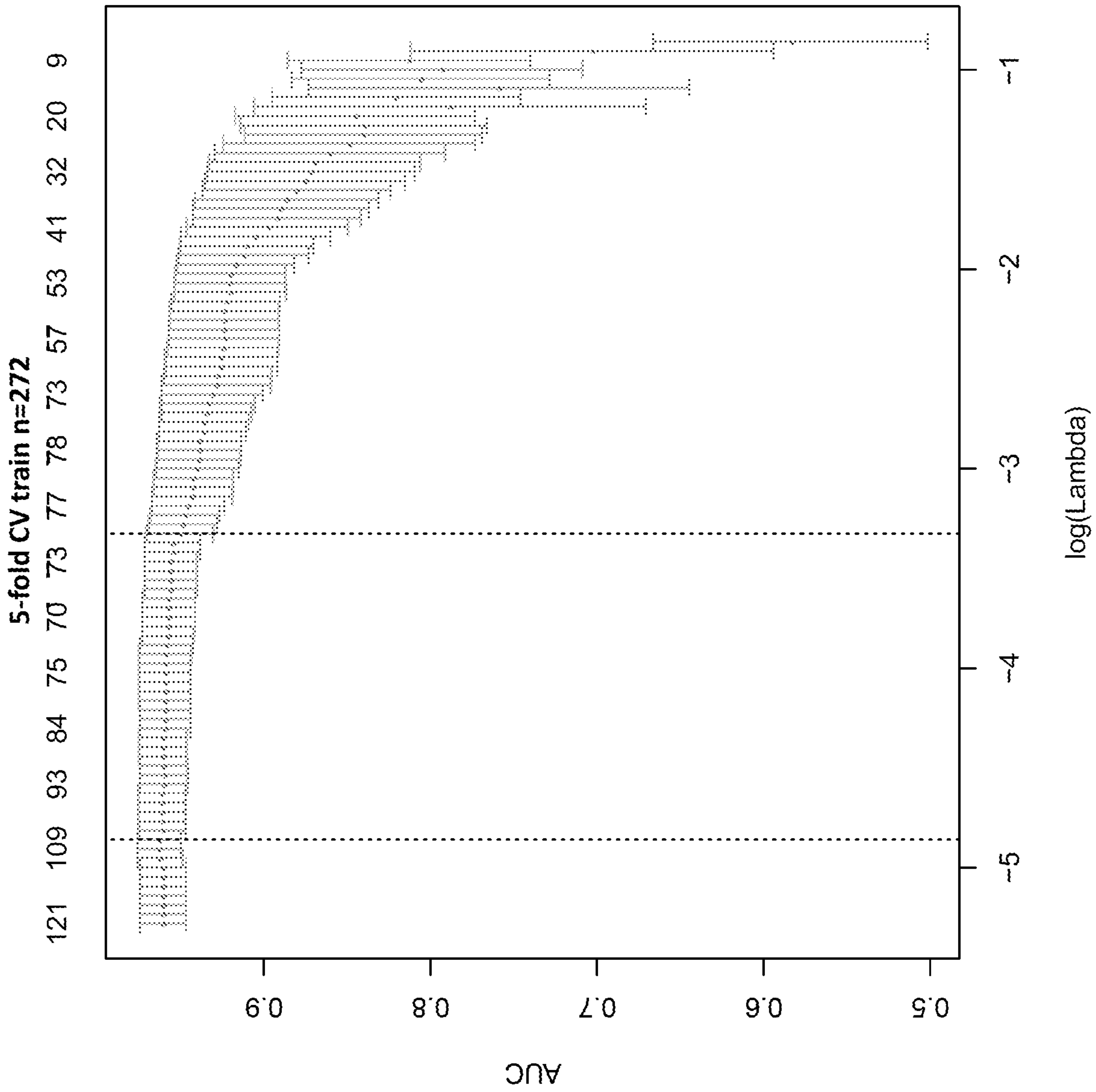
FIG. 10 illustrates the cross-validation curves used to determine the number of features (i.e., gene pairs) to include in the kTSP classifier when the training data was not limited to luminal tumors only. 73 gene pairs were chosen in order to obtain the most parsimonious model within one standard deviation of the number of pairs that provided the best model performance as measured by area under the curve.

Once the training set was selected, feature selection was performed by first identifying approximately 1000 (here 1194) highly variable, highly expressed genes. For every possible gene pair chosen from the set of 1194, the proportion of FGFR3 altered samples having the first gene expression value larger than that for the second gene was calculated, and the same proportion was calculated in the FGFR3 wild-type (i.e., not altered) samples. The absolute difference in proportions was recorded for each gene pair. All gene pairs having an absolute difference greater than 0.525 (i.e., 3949 pairs) were chosen for feature selection using the glmnet software (www.jstatsoft.org/article/view/v033i01) package implemented in R. Glmnet was used with an elastic net mixing parameter of 0.5 to fit a logistic regression model where FGFR3 alteration status was the binary dependent variable and indicator variables for each gene pair taking values of one when expression for the first gene in the pair was higher than the second and zero otherwise were the independent variables. From here, a five (5)-fold cross-validation was performed (see FIG. 10) resulting in 73 TSPs being selected and the final model was fit using the entire training set (Table 4). Once generated, FAS-4 was applied to the training set using Equation 1 and expression data for each gene pair in Table 4 in the same manner as what was done using FAS-3 above in order to ascertain the FGFR3 alteration status for each sample in the training set. Subsequently, FAS-4 was applied to the testing set (i.e., the remainder (i.e., one-third (⅓); n=136) of the TCGA BLCA dataset not used in the training set) in order to ascertain the FGFR3 alteration status for each sample in the set in the same manner as was done for FAS-3 but using FAS-4 (gene pairs from Table 4) instead of FAS-3.

Results

Development of the FAS-3

Figure 8:
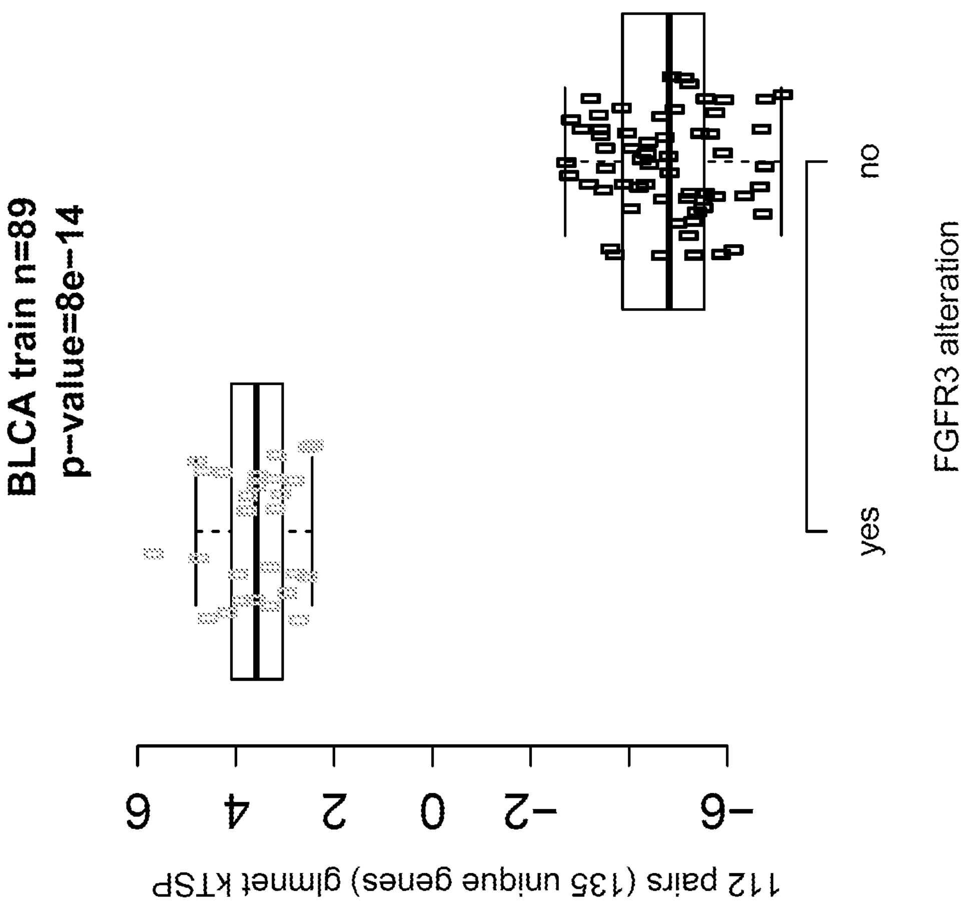
FIG. 8 illustrates boxplots showing the application of the luminal only-trained kTSP classifier (i.e., FAS-3; Table 3) to tumor expression profiles in the training set (n=89). The score shown for any tumor sample was the sum of the classifier model intercept and any gene pair model coefficient where the first gene in the pair has a higher expression value than the second as calculated using Equation 1 (see Table 3 for intercept and gene pair coefficient values). FGFR3 altered tumors in the training set had scores that were clearly higher than wild type tumors and this was reflected in the Wilcoxon-rank sum p-value shown in the title of the graph shown in FIG. 8.
Figure 9:
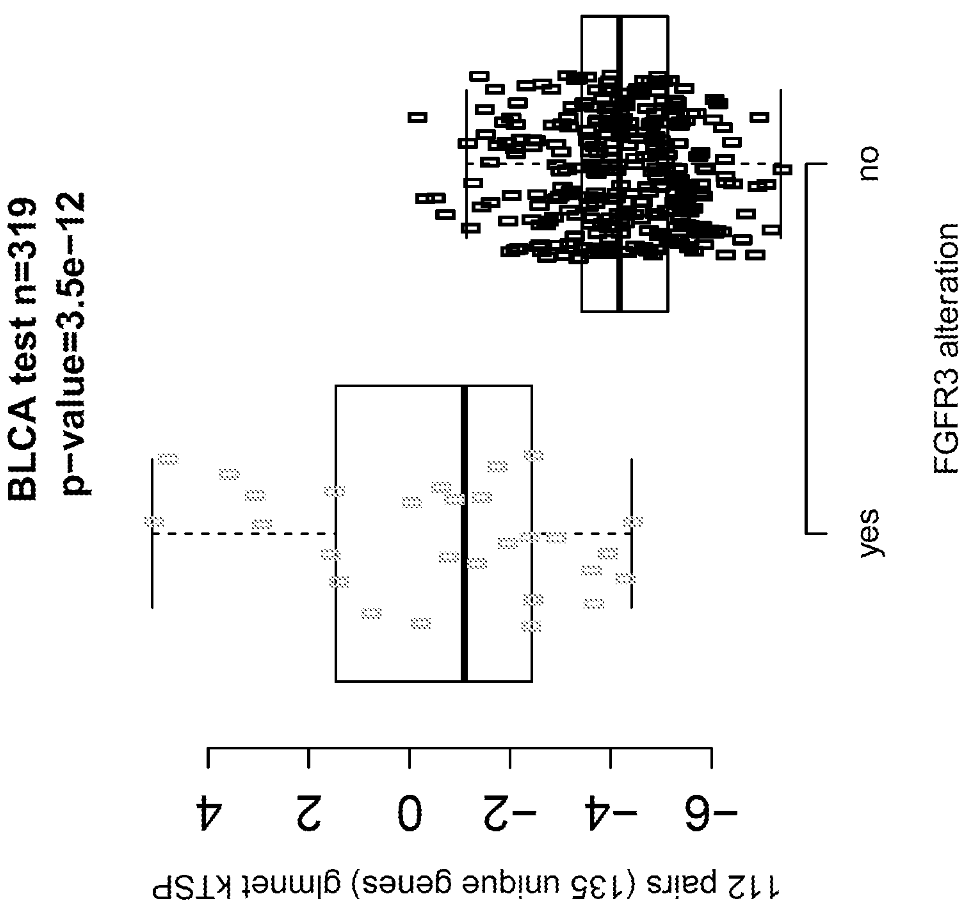
FIG. 9 illustrates boxplots showing the application of the luminal only-trained kTSP classifier (i.e., FAS-3; Table 3) to tumor expression profiles in the testing set (n=319). As for the training set, the score shown for any tumor sample in the testing set was the sum of the classifier model intercept and any gene pair model coefficient where the first gene in the pair has a higher expression value than the second as calculated using Equation 1 (see Table 3 for intercept and gene pair coefficient values). FGFR3 altered tumors in the testing set had scores that were clearly higher than wild type tumors and this is reflected in the Wilcoxon-rank sum p-value shown in the title of the graph shown in FIG. 9.

The final model of FAS-3 was found to contain 112 TSPs for FAS-3 (see Table 3). Further, FAS-3 was effective in grouping samples from either the training set (FIG. 8) or testing set (FIG. 9) as possessing FGFR3 alterations (yes-FAS (+)) or lacking FGFR3 alterations (no-FAS (−)). In all, FAS-3 demonstrated excellent within-training set and testing set performance. FAS-3 will be applied to datasets from other cancers in order to assess the ability of FAS-3 to identify samples possessing FGFR3 alterations across cancer types.

Development of the FAS-4

Figure 11:
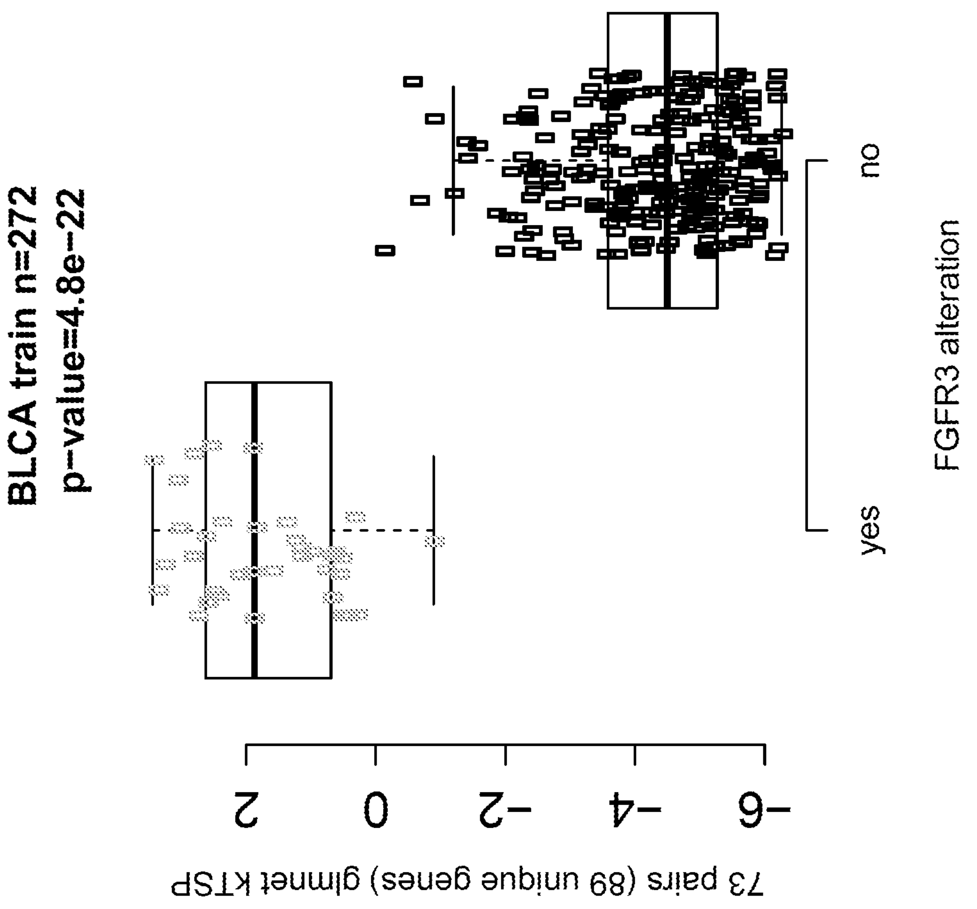
FIG. 11 illustrates boxplots showing the application of the non-luminal only-trained kTSP classifier (i.e., FAS-4; Table 4) to tumor expression profiles in the training set (n=272). The score shown for any tumor sample was the sum of the classifier model intercept and any gene pair model coefficient where the first gene in the pair has a higher expression value than the second as calculated using Equation 1 (see Table 4 for intercept and gene pair coefficient values). FGFR3 altered tumors in the training set had scores that were clearly higher than wild type tumors and this was reflected in the Wilcoxon-rank sum p-value shown in the title of the graph shown in FIG. 11.
Figure 12:
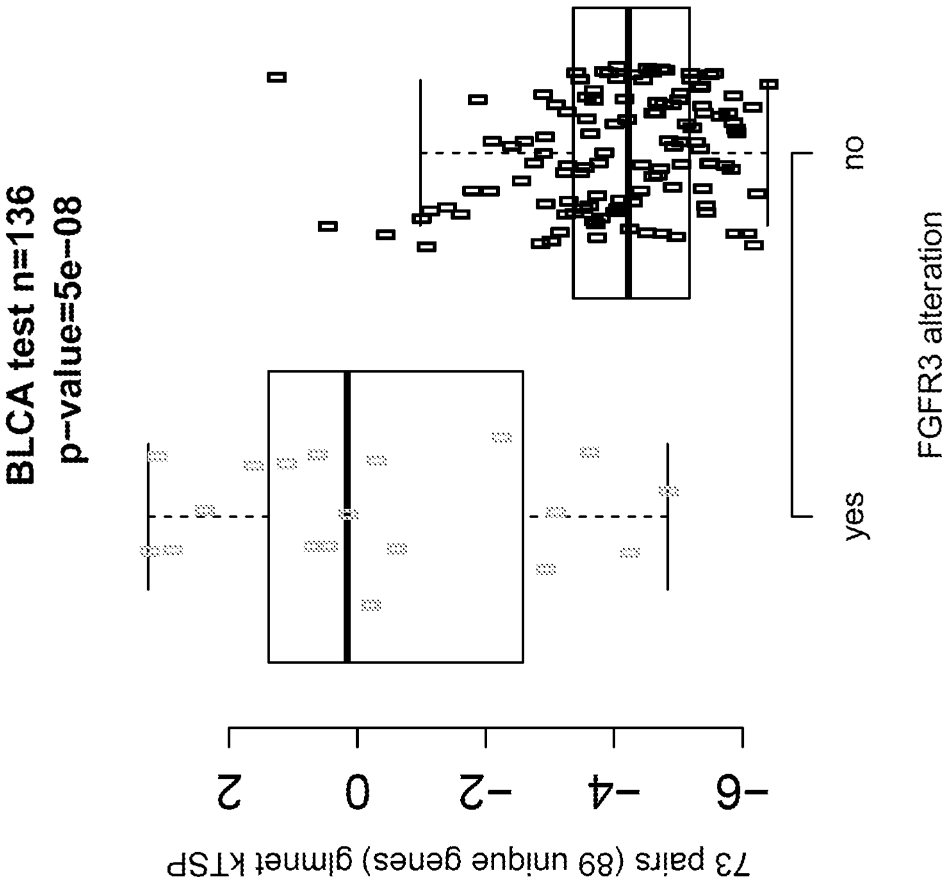
FIG. 12 illustrates boxplots showing the application of the non-luminal only-trained kTSP classifier (i.e., FAS-4; Table 4) to tumor expression profiles in the testing set (n=136). As for the training set, the score shown for any tumor sample in the testing set was the sum of the classifier model intercept and any gene pair model coefficient where the first gene in the pair has a higher expression value than the second as calculated using Equation 1 (see Table 4 for intercept and gene pair coefficient values). FGFR3 altered tumors in the testing set had scores that were clearly higher than wild type tumors and this was reflected in the Wilcoxon-rank sum p-value shown in the title of the graph shown in FIG. 12.

The final model of FAS-4 was found to contain 73 TSPs for FAS-4 (see Table 4). Further, FAS-4 was effective in grouping samples from either the training set (FIG. 11) or testing set (FIG. 12) as possessing FGFR3 alterations (yes-FAS (+)) or lacking FGFR3 alterations (no-FAS (−)). In all, FAS-4 demonstrated excellent within-training set and testing set performance. FAS-3 will be applied to datasets from other cancers in order to assess the ability of FAS-4 to identify samples possessing FGFR3 alterations across cancer types.

TABLE 3

112 TSP Classifier Biomarkers of FAS-3

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 1 | HOXB2 | homeobox B2 | 47 | NM_002145 | ACER2 | alkaline ceramidase 2 | 171 | NM_001010887 | 0.03486 |
| 2 | BCAT1 | branched chain amino acid transaminase 1 | 172 | NM_005504 | AHNAK2 | AHNAK nucleoprotein 2 | 173 | NM_138420 | −0.00016 |
| 3 | COL27A1 | collagen type XXVII alpha 1 chain | 174 | NM_032888 | AKAP12 | A-kinase anchoring protein 12 | 175 | NM_005100 | 0.026789 |

TABLE 3-continued

112 TSP Classifier Biomarkers of FAS-3

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 4 | LY6D | lymphocyte antigen 6 family member D | 62 | NM_003695 | ALDH3B2 | aldehyde dehydrogenase 3 family member B2 | 176 | NM_001031615 | 0.026676 |
| 5 | EMB | embigin | 177 | NM_198449 | AMACR | alpha-methylacyl-CoA racemase | 178 | NM_014324 | 0.078701 |
| 6 | ANXA1 | annexin Al | 179 | NM_000700 | ANXA10 | Annexin A10 | 2 | NM_007193 | −0.14817 |
| 7 | C8orf4 | transcriptional and immune response regulator | 180 | NR_161216 | ANXA10 | Annexin A10 | 2 | NM_007193 | −0.40117 |
| 8 | CRABP2 | cellular retinoic acid binding protein 2 | 181 | NM_001878 | ANXA10 | Annexin A10 | 2 | NM_007193 | −0.07857 |
| 9 | GPRC5A | G protein-coupled receptor class C group 5 member A | 182 | NM_003979 | ANXA10 | Annexin A10 | 2 | NM_007193 | −0.04884 |
| 10 | RARRES 1 | retinoic acid receptor responder 1 | 183 | NM_206963 | ANXA10 | Annexin A10 | 2 | NM_007193 | −0.05774 |
| 11 | S100A14 | S100 calcium binding protein A14 | 184 | NM_020672 | ANXA10 | Annexin A10 | 2 | NM_007193 | −0.24391 |
| 12 | SELENB P1 | selenium binding protein 1 | 185 | NM_003944 | ANXA10 | Annexin A10 | 2 | NM_007193 | −0.14085 |
| 13 | KLHDC9 | kelch domain containing 9 | 186 | NM_152366 | ANXA3 | annexin A3 | 187 | NM_005139 | 0.27313 |
| 14 | SPATA18 | spermatogenesis associated 18 | 188 | NM_145263 | ANXA3 | annexin A3 | 187 | NM_005139 | 0.11078 |
| 15 | PLAG1 | PLAG1 zinc finger | 76 | NM_002655 | APOC1 | apolipoprotein C 1 | 189 | NM_001645 | 0.230278 |
| 16 | NFIB | nuclear factor I B | 190 | NM_001190737 | BAHCC1 | BAH domain and coiled-coil containing 1 | 191 | NM_001291324 | −0.0039 |
| 17 | NDUFA4 L2 | NDUFA4 mitochondria 1 complex associated like 2 | 71 | NM_020142 | BAMBI | BMP and activin membrane bound inhibitor | 192 | NM_012342 | 0.078215 |
| 18 | UPK3BL | uroplakin 3B like 1 | 193 | NM_001114403 | BAMBI | BMP and activin membrane bound inhibitor | 192 | NM_012342 | 0.27432 |
| 19 | CA9 | carbonic anhydrase 9 | 12 | NM_001216 | BCAT1 | branched chain amino acid transaminase 1 | 172 | NM_005504 | 0.070035 |
| 20 | HS6ST3 | heparan sulfate 6-O-sulfotransferase 3 | 194 | NM_153456 | BCAT1 | branched chain amino acid transaminase 1 | 172 | NM_005504 | 0.104057 |
| 21 | MT1E | metallothionein 1E | 195 | NM_001363555 | BCAT1 | branched chain amino acid transaminase 1 | 172 | NM_005504 | 0.353643 |

TABLE 3-continued

112 TSP Classifier Biomarkers of FAS-3

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 22 | NFIB | nuclear factor I B | 190 | NM_001190737 | BCL11B | BAF chromatin remodeling complex subunit BCL11B | 191 | NM_001291324 | −0.01582 |
| 23 | NDUFA4 L2 | NDUFA4 mitochondria 1 complex associated like 2 | 71 | NM_020142 | BIRC5 | baculoviral IAP repeat containing 5 | 192 | NM_012342 | 0.036257 |
| 24 | PARP11 | poly(ADP-ribose) polymerase family member 11 | 193 | NM_001114403 | C12orf75 | C12orf75 | 194 | NM_153456 | 0.006724 |
| 25 | TFR2 | transferrin receptor 2 | 195 | NM_001363555 | C12orf75 | C12orf75 | 194 | NM_153456 | 0.191613 |
| 26 | FAIM3 | FAIM3 | 196 | NM_005449 | C15orf48 | chromosome 15 open reading frame 48 | 197 | NM_197955 | 0.053583 |
| 27 | IRAK3 | interleukin 1 receptor associated kinase 3 | 198 | NM_007199 | C15orf48 | chromosome 15 open reading frame 48 | 197 | NM_197955 | 0.066301 |
| 28 | NR2F1 | nuclear receptor subfamily 2 group F member 1 | 199 | NM_005654 | C15orf48 | chromosome 15 open reading frame 48 | 197 | NM_197955 | 0.05848 |
| 29 | SPTLC3 | serine palmitoyltransferase long chain base subunit 3 | 200 | NM_018327 | C16orf45 | bMERB domain containing 1 | 10 | NM_033201 | −0.00363 |
| 30 | CDKN1C | cyclin dependent kinase inhibitor 1C | 201 | NM_000076 | CA9 | carbonic anhydrase 9 | 12 | NM_001216 | −0.27088 |
| 31 | KRT14 | keratin 14 | 202 | NM_000526 | CA9 | carbonic anhydrase 9 | 12 | NM_001216 | −0.01781 |
| 32 | NAV2 | neuron navigator 2 | 203 | NM_182964 | CA9 | carbonic anhydrase 9 | 12 | NM_001216 | −0.00058 |
| 33 | NEBL | nebulette | 204 | NM_006393 | CA9 | carbonic anhydrase 9 | 12 | NM_001216 | −0.13176 |
| 34 | IL17RE | interleukin 17 receptor E | 205 | NM_153480 | CACNA1H | calcium voltage-gated channel subunit alpha l H | 206 | NM_021098 | −0.02166 |
| 35 | MME | membrane metalloendo-peptidase | 207 | NM_000902 | CAP2 | cyclase associated actin cytoskeleton regulatory protein 2 | 208 | NM_006366 | −0.21689 |
| 36 | LCN2 | lipocalin 2 | 209 | NM_005564 | CASP1 | caspase 1 | 210 | NM_033292 | −0.09608 |
| 37 | HS6ST3 | heparan sulfate 6-O-sulfotransferase 3 | 194 | NM_153456 | CDK14 | cyclin dependent kinase 14 | 211 | NM_001287135 | 0.230562 |
| 38 | NFIB | nuclear factor I B | 190 | NM_001190737 | CECR1 | adenosine deaminase 2 | 212 | NM_177405 | −0.02498 |
| 39 | KIF26B | kinesin family member 26B | 213 | NM_018012 | CENPA | centromere protein A | 214 | NM_001809 | 0.029712 |
| 40 | HOXB2 | homeobox B2 | 47 | NM_002145 | CFB | complement factor B | 215 | NM_001710 | 0.514118 |
| 41 | LDOC1 | LDOC1 regulator of NFKB signaling | 216 | NM_012317 | CFB | complement factor B | 215 | NM_001710 | 0.307606 |
| 42 | FZD10 | frizzled class receptor 10 | 217 | NM_007197 | CLDN3 | claudin 3 | 218 | NM_001306 | 0.291878 |
| 43 | IRAK3 | interleukin 1 receptor associated kinase 3 | 198 | NM_007199 | CLDN3 | claudin 3 | 218 | NM_001306 | 0.100018 |

TABLE 3-continued

| 112 TSP Classifier Biomarkers of FAS-3 | | | | | | | | | |
|---|---|---|---|---|---|---|---|---|---|
| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
| 44 | FBLN5 | fibulin 5 | 219 | NM_006329 | COL14A1 | collagen type XIV alpha 1 chain | 220 | NM_021110 | 0.019776 |
| 45 | THBS2 | thrombospondin 2 | 221 | NM_003247 | COL27A1 | collagen type XXVII alpha 1 chain | 174 | NM_032888 | −0.15759 |
| 46 | NFIB | nuclear factor I B | 190 | NM_001190737 | CPE | carboxypeptidase E | 222 | NM_001873 | −0.11099 |
| 47 | IL17RE | interleukin 17 receptor E | 205 | NM _153480 | CREB3L1 | cAMP responsive element binding protein 3 like 1 | 223 | NM_052854 | −0.17438 |
| 48 | SLC7A5 | solute carrier family 7 member 5 | 224 | NM_003486 | D4S234E | neuronal vesicle trafficking associated 1 | 141 | NM_001382227 | −0.00017 |
| 49 | ZNF608 | zinc finger protein 608 | 129 | NM_020747 | DCBLD2 | discoidin, CUB and LCCL domain containing 2 | 225 | NM_080927 | 0.002131 |
| 50 | LUM | lumican | 226 | NM_002345 | DFNA5 | DFNA5, deafness associated tumor suppressor | 16 | NM_004403 | −0.10338 |
| 51 | SCARA3 | scavenger receptor class A member 3 | 227 | NM_016240 | DOK7 | docking protein 7 | 19 | NM_173660 | −0.1267 |
| 52 | TUBB2A | tubulin beta 2A class IIa | 228 | NM_001069 | DUSP10 | dual specificity phosphatase 10 | 229 | NM_007207 | −0.0654 |
| 53 | MME | membrane metalloendo-peptidase | 207 | NM_000902 | ENPP2 | ectonucleotide pyrophosphatase/ phosphodiesterase 2 | 230 | NM_006209 | −0.00499 |
| 54 | NFIB | nuclear factor I B | 190 | NM_001190737 | ENPP2 | ectonucleotide pyrophosphatase/ phosphodiesterase 2 | 230 | NM_006209 | −0.03458 |
| 55 | HOXB2 | homeobox B2 | 47 | NM_002145 | FGFR2 | fibroblast growth factor receptor 2 | 231 | NM_000141 | 0.08062 |
| 56 | LY6D | lymphocyte antigen 6 family member D | 62 | NM_003695 | FGFR2 | fibroblast growth factor receptor 2 | 231 | NM_000141 | 0.105299 |
| 57 | PDE10A | phosphodiesterase 10A | 232 | NM_001130690 | FGFR2 | fibroblast growth factor receptor 2 | 231 | NM_000141 | 0.372934 |
| 58 | UPK2 | uroplakin 2 | 233 | NM_006760 | FGFR3 | fibroblast growth factor receptor 3 | 32 | NM_000142 | −0.01226 |
| 59 | IGSF9 | immunoglobulin superfamily member 9 | 234 | NM_001135050 | FXYD5 | FXYD domain containing ion transport regulator 5 | 235 | NM_144779 | −0.22236 |
| 60 | PDE10A | phosphodieseraset 10A | 232 | NM_001130690 | GBP4 | guanylate binding protein 4 | 236 | NM_052941 | 0.077678 |
| 61 | IL17RE | interleukin 17 receptor E | 205 | NM_153480 | GMFG | glia maturation factor gamma | 237 | NM_004877 | −0.1617 |
| 62 | LY6D | lymphocyte antigen 6 family member D | 62 | NM_003695 | GPX2 | glutathione peroxidase 2 | 238 | NM_002083 | 0.10642 |
| 63 | PLAG1 | PLAG1 zinc finger | 76 | NM_002655 | HIST1H2B D | H2B clustered histone 5 | 239 | AF531287 | 0.046501 |
| 64 | LDOC1 | LDOC1 regulator of NFKB signaling | 216 | NM_012317 | HIST2H4A | H4 clustered histone 14 | 240 | NM_003548 | 0.059189 |
| 65 | SGPP1 | sphingosine-1-phosphate phosphatase 1 | 241 | NM_030791 | HMGN5 | high mobility group nucleosome binding domain 5 | 242 | NM_030763 | −0.04185 |

TABLE 3-continued

112 TSP Classifier Biomarkers of FAS-3

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 66 | LDHD | lactate dehydrogenase D | 243 | NM_153486 | HOXB2 | homeobox B2 | 47 | NM_002145 | −0.04968 |
| 67 | MME | membrane metalloendo-peptidase | 207 | NM_000902 | HOXB2 | homeobox B2 | 47 | NM_002145 | −0.02344 |
| 68 | SHROOM3 | shroom family member 3 | 244 | NM_020859 | HS6ST3 | heparan sulfate 6-O-sulfotransferase 3 | 194 | NM_153456 | −0.01854 |
| 69 | PTPRR | protein tyrosine phosphatase receptor type R | 245 | NM_002849 | HSD11B2 | hydroxysteroid 11-beta dehydrogenase 2 | 246 | NM_000196 | 0.016811 |
| 70 | RTP4 | receptor transporter protein 4 | 247 | NM_022147 | HSD11B2 | hydroxysteroid 11-beta dehydrogenase 2 | 246 | NM_000196 | 0.0076 |
| 71 | LY6D | lymphocyte antigen 6 family member D | 62 | NM_003695 | IGSF9 | immunoglobulin superfamily member 9 | 234 | NM_001135050 | 0.028926 |
| 72 | SH3TC1 | SH3 domain and tetratricopeptide repeats 1 | 248 | NM_018986 | IL32 | interleukin 32 | 249 | NM_001012631 | 0.211503 |
| 73 | PLAG1 | PLAG1 zinc finger | 76 | NM_002655 | KCNQ1OT 1 | KCNQ1 opposite strand/antisense transcript 1 | 250 | NR_002728 | 0.127442 |
| 74 | NFIB | nuclear factor I B | 190 | NM_001190737 | KCNS3 | potassium voltage-gated channel modifier subfamily S member 3 | 251 | NM_002252 | −0.21611 |
| 75 | PTGS1 | prostaglandin-endoperoxide synthase 1 | 252 | NM_000962 | KIF26B | kinesin family member 26B | 213 | NM_018012 | −0.10691 |
| 76 | SEC16B | SEC16 homolog B, endoplasmic reticulum export factor | 253 | NM_033127 | KLF8 | Kruppel like factor 8 | 254 | NM_007250 | 0.060764 |
| 77 | ZNF502 | zinc finger protein 502 | 394 | NM_033210 | KLF8 | Kruppel like factor 8 | 254 | NM_007250 | 0.235772 |
| 78 | LDOC1 | LDOC1 regulator of NFKB signaling | 216 | NM_012317 | LCN2 | lipocalin 2 | 209 | NM_005564 | 0.020846 |
| 79 | SGPP1 | sphingosine-1-phosphate phosphatase 1 | 241 | NM_030791 | LPHN2 | adhesion G protein-coupled receptor L2 | 255 | NM_012302 | −0.80045 |
| 80 | TUBB2A | tubulin beta 2A class IIa | 228 | NM_001069 | LPHN2 | adhesion G protein-coupled receptor L2 | 255 | NM_012302 | −0.05841 |
| 81 | NDRG4 | NDRG family member 4 | 256 | NM_020465 | LY6D | lymphocyte antigen 6 family member D | 62 | NM_003695 | −0.00752 |
| 82 | PLAT | plasminogen activator, tissue type | 257 | NM_000930 | LY6D | lymphocyte antigen 6 family member D | 62 | NM_003695 | −0.42366 |
| 83 | RHOBTB 3 | Rho related BTB domain containing 3 | 258 | NM_014899 | LY6D | lymphocyte antigen 6 family member D | 62 | NM_003695 | −0.0442 |
| 84 | SELENB P1 | selenium binding protein 1 | 185 | NM_003944 | LY6D | lymphocyte antigen 6 family member D | 62 | NM_003695 | −0.08864 |
| 85 | SLC7A5 | solute carrier family 7 member 5 | 224 | NM_003486 | LY6D | lymphocyte antigen 6 family member D | 62 | NM_003695 | −0.08183 |

TABLE 3-continued

112 TSP Classifier Biomarkers of FAS-3

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 86 | UBE2C | ubiquitin conjugating enzyme E2 C | 259 | NM_007019 | LY6D | lymphocyte antigen 6 family member D | 62 | NM_003695 | −0.1239 |
| 87 | NEBL | nebulette | 204 | NM_006393 | MCTP2 | multiple C2 and transmembrane domain containing 2 | 66 | NM_018349 | −0.19611 |
| 88 | PHGDH | phosphoglycerate dehydrogenase | 260 | NM_006623 | MDFI | MyoD family inhibitor | 67 | NM_001300804 | −0.11602 |
| 89 | PLAU | plasminogen activator, urokinase | 261 | NM_002658 | MDFI | MyoD family inhibitor | 67 | NM_001300804 | −0.16738 |
| 90 | VTCN1 | V-set domain containing T cell activation inhibitor 1 | 262 | NM_024626 | MGAT3 | beta-1,4-mannosyl-glycoprotein 4-beta-N-acetylglucos-aminyltransferase | 263 | NM_002409 | −0.0765 |
| 91 | SLC16A1 | solute carrier family 16 member 1 | 264 | NM_003051 | NDN | necdin, MAGE family member | 265 | NM_002487 | −0.16315 |
| 92 | TUBB2A | tubulin beta 2A class IIa | 228 | NM_001069 | NDN | necdin, MAGE family member | 265 | NM_002487 | −0.07796 |
| 93 | PHGDH | phosphoglycerate dehydrogenase | 260 | NM_006623 | NDUFA4L 2 | NDUFA4 mitochondria 1 complex associated like 2 | 71 | NM_020142 | −0.33628 |
| 94 | PRSS8 | serine protease 8 | 266 | NM_002773 | NDUFA4L 2 | NDUFA4 mitochondria 1 complex associated like 2 | 71 | NM_020142 | −0.19352 |
| 95 | SCNN1B | sodium channel epithelial 1 subunit beta | 267 | NM_000336 | NDUFA4L 2 | NDUFA4 mitochondria 1 complex associated like 2 | 71 | NM_020142 | −0.01524 |
| 96 | TMEM98 | transmembrane protein 98 | 268 | NM_015544 | NDUFA4L 2 | NDUFA4 mitochondria 1 complex associated like 2 | 71 | NM_020142 | −0.04695 |
| 97 | PDE10A | phosphodiesterase 10A | 232 | NM_001130690 | NFIB | nuclear factor I B | 190 | NM_001190737 | 0.269803 |
| 98 | SLC44A5 | solute carrier family 44 member 5 | 269 | NM_152697 | NFIB | nuclear factor I B | 190 | NM_001190737 | 0.134906 |
| 99 | SRRM3 | serine/arginine repetitive matrix 3 | 270 | NM_001291831 | NFIB | nuclear factor I B | 190 | NM_001190737 | 0.058966 |
| 100 | THNSL2 | threonine synthase like 2 | 271 | NM_018271 | NFIB | nuclear factor I B | 190 | NM_001190737 | 0.409683 |
| 101 | ZC4H2 | zinc finger C4H2-type containing | 272 | NM_018684 | NFIB | nuclear factor I B | 190 | NM_001190737 | 0.229126 |
| 102 | SLAIN 1 | SLAIN motif family member 1 | 273 | NM_001040153 | PLEKHB1 | pleckstrin homology domain containing B1 | 274 | NM_021200 | 0.094333 |
| 103 | SLC1A3 | solute carrier family 1 member 3 | 275 | NM_004172 | PLXDC2 | plexin domain containing 2 | 276 | NM_032812 | −0.13861 |
| 104 | SGPP1 | sphingosine-1-phosphate phosphatase 1 | 241 | NM_030791 | PNCK | pregnancy up-regulated nonubiquitous CaM kinase | 277 | NM_001039582 | −0.13225 |
| 105 | TUBB2A | tubulin beta 2A class IIa | 228 | NM_001069 | PPP1R9A | protein phosphatase 1 regulatory subunit 9A | 278 | NM_001166160 | −0.17974 |

TABLE 3-continued

| 112 TSP Classifier Biomarkers of FAS-3 | | | | | | | | | |
|---|---|---|---|---|---|---|---|---|---|
| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
| 106 | TFR2 | transferrin receptor 2 | 195 | NM_001363555 | RASL11B | RAS like family 11 member B | 279 | NM_023940 | 0.039752 |
| 107 | ZC4H2 | zinc finger C4H2-type containing | 272 | NM_018684 | SCIN | scinderin | 280 | NM_001112706 | 0.128661 |
| 108 | SNRPN | small nuclear ribonucleoprotein polypeptide N | 281 | NM_003097 | SCNN1B | sodium channel epithelial 1 subunit beta | 267 | NM_000336 | 0.093233 |
| 109 | SNRPN | small nuclear ribonucleoprotein polypeptide N | 281 | NM_003097 | SCUBE2 | signal peptide, CUB domain and EGF like domain containing 2 | 282 | NM_020974 | 0.262314 |
| 110 | SLAIN1 | SLAIN motif family member 1 | 273 | NM_001040153 | SGPP1 | sphingosine-1-phosphate phosphatase 1 | 241 | NM_030791 | 0.223332 |
| 111 | SPTLC3 | serine palmitoyltransferase long chain base subunit 3 | 200 | NM_018327 | SLC2A9 | solute carrier family 2 member 9 | 283 | NM_020041 | −0.18076 |
| 112 | STC2 | stanniocalcin 2 | 284 | NM_003714 | SLCO3A1 | solute carrier organic anion transporter family member 3A1 | 285 | NM_013272 | −0.00497 |
| | | | | | Intercept | | | | −1.07005 |

TABLE 4

| 73 TSP Classifier Biomarkers of FAS-4 | | | | | | | | | |
|---|---|---|---|---|---|---|---|---|---|
| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
| 1 | CA9 | carbonic anhydrase 9 | 12 | NM_001216 | ADAM19 | ADAM metallopeptidase domain 19 | 286 | NM_033274 | 0.161469 |
| 2 | ANXA3 | annexin A3 | 187 | NM_005139 | ADORA2B | adenosine A2b receptor | 287 | NM_000676 | −0.02444 |
| 3 | EPHX3 | epoxide hydrolase 3 | 288 | NM_024794 | AKAP12 | A-kinase anchoring protein 12 | 175 | NM_005100 | 0.029459 |
| 4 | HOXB3 | homeobox B3 | 48 | NM_002146 | AKAP12 | A-kinase anchoring protein 12 | 175 | NM_005100 | 0.015477 |
| 5 | PLAG1 | PLAG1 zinc finger | 76 | NM_002655 | AKAP12 | A-kinase anchoring protein 12 | 175 | NM_005100 | 0.072414 |
| 6 | FAP | fibroblast activation protein alpha | 289 | NM_004460 | ALOX5AP | arachidonate 5-lipoxygenase activating protein | 290 | NM_001629 | −0.17491 |
| 7 | PLAG1 | PLAG1 zinc finger | 76 | NM_002655 | APOC1 | apolipoprotein C1 | 189 | NM_001645 | 0.077154 |
| 8 | SEC16B | SEC16 homolog B, endoplasmic reticulum export factor | 253 | NM_033127 | AXL | AXL receptor tyrosine kinase | 290 | NM_001629 | 0.216211 |

TABLE 4-continued

73 TSP Classifier Biomarkers of FAS-4

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 9 | SOD3 | superoxide dismutase 3 | 291 | NM_003102 | B3GNT7 | UDP-GlcNAc:betaGal beta-1,3-N-acetylgluco-saminyltransferase 7 | 292 | NM_145236 | −0.37051 |
| 10 | SCARA3 | scavenger receptor class A member 3 | 227 | NM_016240 | BAIAP3 | BAH associated protein 3 | 293 | NM_003933 | −0.15435 |
| 11 | NR2F1 | nuclear receptor subfamily 2 group F member 1 | 199 | NM_005654 | BCAT1 | branched chain amino acid transaminase 1 | 172 | NM_005504 | 0.038952 |
| 12 | SLC2A9 | solute carrier family 2 member 9 | 283 | NM_020041 | BCAT1 | branched chain amino acid transaminase 1 | 172 | NM_005504 | 0.177134 |
| 13 | ZNF608 | zinc finger protein 608 | 129 | NM_020747 | BCAT1 | branched chain amino acid transaminase 1 | 172 | NM_005504 | 0.090849 |
| 14 | GBP1 | guanylate binding protein 1 | 294 | NM_002053 | C15orf52 | coiled-coil domain containing 9B | 295 | NM_207380 | −0.15168 |
| 15 | SPOCD1 | SPOC domain containing 1 | 103 | NM_144569 | C1orf116 | chromosome 1 open reading frame 116 | 296 | NM_023938 | 0.067469 |
| 16 | MME | membrane metalloendo-peptidase | 207 | NM_000902 | CA9 | carbonic anhydrase 9 | 12 | NM_001216 | −0.378 |
| 17 | NEBL | nebulette | 204 | NM_006393 | CA9 | carbonic anhydrase 9 | 12 | NM_001216 | −0.07441 |
| 18 | NPNT | nephronectin | 297 | NM_001184690 | CA9 | carbonic anhydrase 9 | 12 | NM_001216 | −0.0576 |
| 19 | SCARA3 | scavenger receptor class A member 3 | 227 | NM_016240 | CA9 | carbonic anhydrase 9 | 12 | NM_001216 | −0.10862 |
| 20 | TGFBI | transforming growth factor beta induced | 298 | NM_000358 | CAPNS2 | calpain small subunit 2 | 299 | NM_032330 | −0.24318 |
| 21 | PLCH2 | phospholipase C eta 2 | 78 | NM_014638 | CFB | complement factor B | 215 | NM_001710 | 0.120496 |
| 22 | PLXNB3 | plexin B3 | 81 | NM_005393 | CFB | complement factor B | 215 | NM_001710 | 0.167017 |
| 23 | NDUFA4 L2 | NDUFA4 mitochondrial complex associated like 2 | 71 | NM_020142 | CKB | creatine kinase B | 300 | NM_001823 | 0.148674 |
| 24 | SPOCD1 | SPOC domain containing 1 | 103 | NM_144569 | CKB | creatine kinase B | 300 | NM_001823 | 0.125414 |
| 25 | FGFR3 | fibroblast growth factor receptor 3 | 32 | NM_000142 | CLDN1 | claudin 1 | 301 | NM_021101 | 0.134574 |
| 26 | TMPRSS 4 | transmembrane serine protease 4 | 115 | NM_019894 | CLDN1 | claudin 1 | 301 | NM_021101 | 0.120605 |
| 27 | MME | membrane metalloendo-peptidase | 207 | NM_000902 | CLEC2B | C-type lectin domain family 2 member B | 302 | NM_005127 | −0.00597 |
| 28 | SPOCD1 | SPOC domain containing 1 | 103 | NM_144569 | CSPG4 | chondroitin sulfate proteoglycan 4 | 303 | NM_001897 | 0.203337 |

TABLE 4-continued

73 TSP Classifier Biomarkers of FAS-4

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 29 | RNF43 | ring finger protein 43 | 304 | NM_017763 | D4S234E | neuronal vesicle trafficking associated 1 | 141 | NM_001382227 | −0.07633 |
| 30 | SPOCD1 | SPOC domain containing 1 | 103 | NM_144569 | DPYSL3 | dihydropyrimidinase like 3 | 305 | NM_001197294 | 0.110113 |
| 31 | WDR72 | WD repeat domain 72 | 306 | NM_182758 | DPYSL3 | dihydropyrimidinase like 3 | 305 | NM_001197294 | 0.341711 |
| 32 | LY6D | lymphocyte antigen 6 family member D | 62 | NM_003695 | DSP | desmoplakin | 307 | NM_004415 | 0.117019 |
| 33 | SPOCD1 | SPOC domain containing 1 | 103 | NM_144569 | DUSP2 | dual specificity phosphatase 2 | 308 | NM_004418 | 0.055531 |
| 34 | PRR15 | proline rich 15 | 309 | NM_175887 | EPB41L4B | erythrocyte membrane protein band 4.1 like 4B | 310 | NM_018424 | 0.030909 |
| 35 | SLC2A9 | solute carrier family 2 member 9 | 283 | NM_020041 | EPB41L4B | erythrocyte membrane protein band 4.1 like 4B | 310 | NM_018424 | 0.424268 |
| 36 | SRCIN1 | SRC kinase signaling inhibitor 1 | 311 | NM_025248 | EPB41L4B | erythrocyte membrane protein band 4.1 like 4B | 310 | NM_018424 | 0.056891 |
| 37 | PTK6 | protein tyrosine kinase 6 | 312 | NM_005975 | EPCAM | epithelial cell adhesion molecule | 313 | NM_002354 | 0.077346 |
| 38 | MME | membrane metalloendo-peptidase | 207 | NM_000902 | EPHX3 | epoxide hydrolase 3 | 288 | NM_024794 | −0.19189 |
| 39 | FGFR3 | fibroblast growth factor receptor 3 | 32 | NM_000142 | EVPL | envoplakin | 314 | NM_001320747 | 0.507467 |
| 40 | TMEM97 | transmembrane protein 97 | 315 | NM_014573 | FAM174B | family with sequence similarity 174 member B | 31 | NM_207446 | −0.09521 |
| 41 | FGFR3 | fibroblast growth factor receptor 3 | 32 | NM_000142 | FBLN1 | fibulin 1 | 316 | NM_006487 | 0.01309 |
| 42 | SDK1 | sidekick cell adhesion molecule 1 | 317 | NM_152744 | FSTL4 | follistatin like 4 | 318 | NM_015082 | −0.34138 |
| 43 | HOXB2 | homeobox B2 | 47 | NM_002145 | GBP1 | guanylate binding protein 1 | 294 | NM_002053 | 0.38022 |
| 44 | SPOCD1 | SPOC domain containing 1 | 103 | NM_144569 | GSDMB | gasdermin B | 319 | NM_001042471 | 0.07541 |
| 45 | QPCT | glutaminyl-peptide cyclotransferase | 320 | NM_012413 | HOXB6 | homeobox B6 | 50 | NM_018952 | −0.08145 |
| 46 | SPOCD1 | SPOC domain containing 1 | 103 | NM_144569 | IFI30 | IFI30 lysosomal thiol reductase | 321 | NM_006332 | 0.065198 |
| 47 | PLXNB3 | plexin B3 | 81 | NM_005393 | IFITM1 | interferon induced transmembrane protein 1 | 322 | NM_003641 | 0.006121 |

TABLE 4-continued

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 73 TSP Classifier Biomarkers of FAS-4 | | | | | | | | | |
| 48 | SOX15 | SRY-box transcription factor 15 | 101 | NM_006942 | IFITM1 | interferon induced transmembrane protein 1 | 322 | NM_003641 | 0.02918 |
| 49 | MME | membrane metalloendo-peptidase | 207 | NM_000902 | KCNC3 | potassium voltage-gated channel subfamily C member 3 | 323 | NM_004977 | −0.09724 |
| 50 | SPOCD1 | SPOC domain containing 1 | 103 | NM_144569 | KCNG1 | potassium voltage-gated channel modifier subfamily G member 1 | 324 | NM_002237 | 0.044499 |
| 51 | SPOCD1 | SPOC domain containing 1 | 103 | NM_144569 | LAMA3 | laminin subunit alpha 3 | 325 | NM_198129 | 0.256536 |
| 52 | ZNF608 | zinc finger protein 608 | 129 | NM_020747 | MATN2 | matrilin 2 | 326 | NM_002380 | 0.151405 |
| 53 | TGFBI | transforming growth factor beta induced | 298 | NM_000358 | MDFI | MyoD family inhibitor | 67 | NM_001300804 | −0.18251 |
| 54 | SLC2A9 | solute carrier family 2 member 9 | 283 | NM_020041 | MME | membrane metalloendo-peptidase | 207 | NM_000902 | 0.312094 |
| 55 | SPOCD1 | SPOC domain containing 1 | 103 | NM_144569 | MXRA8 | matrix remodeling associated 8 | 327 | NM_001282585 | 0.01723 |
| 56 | SPOCD1 | SPOC domain containing 1 | 103 | NM_144569 | MYADM | myeloid associated differentiation marker | 328 | NM_001020818 | 0.008143 |
| 57 | PLXNB3 | plexin B3 | 81 | NM_005393 | MYO5B | myosin VB | 329 | NM_001080467 | 0.102711 |
| 58 | SPOCD1 | SPOC domain containing 1 | 103 | NM 144569 | MYO5B | myosin VB | 329 | NM_001080467 | 0.21098 |
| 59 | PRSS8 | serine protease 8 | 266 | NM_00277 | NDUFA4L 2 | NDUFA4 mitochondrial complex associated like 2 | 71 | NM_020142 | −0.09134 |
| 60 | SCARA3 | scavenger receptor class A member 3 | 227 | NM_016240 | NDUFA4L 2 | NDUFA4 mitochondrial complex associated like 2 | 71 | NM_020142 | −0.1936 |
| 61 | SPOCD1 | SPOC domain containing 1 | 103 | NM_144569 | NR4A1 | nuclear receptor subfamily 4 group A member 1 | 330 | NM_002135 | 0.168181 |
| 62 | SDK1 | sidekick cell adhesion molecule 1 | 317 | NM_152744 | PDE10A | phosphodiesterase 10A | 232 | NM_001130690 | −0.04975 |
| 63 | PRRX1 | paired related homeobox 1 | 331 | NM_006902 | PDE4B | phosphodiesterase 4B | 332 | NM_002600 | −0.07226 |
| 64 | TUBB2A | tubulin beta 2A class IIa | 228 | NM_001069 | PPP1R9A | protein phosphatase 1 regulatory subunit 9A | 278 | NM_001166160 | −0.25608 |
| 65 | SPOCD1 | SPOC domain containing 1 | 103 | NM_144569 | RCN3 | reticulocalbin 3 | 333 | NM_020650 | 0.012668 |
| 66 | SLC2A9 | solute carrier family 2 member 9 | 283 | NM_020041 | SCARA3 | scavenger receptor class A member 3 | 227 | NM_016240 | 0.24457 |

TABLE 4-continued

73 TSP Classifier Biomarkers of FAS-4

| Gene Pair No. | Gene Symbol (A gene) | Gene Name | SEQ ID NO: | GenBank Accession Number* | Gene Symbol (B gene) | Gene Name | SEQ ID NO: | GenBank Accession Number* | Coefficient |
|---|---|---|---|---|---|---|---|---|---|
| 67 | SRRM3 | serine/arginine repetitive matrix 3 | 270 | NM_001291831 | SCARA3 | scavenger receptor class A member 3 | 227 | NM_016240 | 0.202025 |
| 68 | SELL | selectin L | 334 | NM_000655 | SEC16B | SEC 16 homolog B, endoplasmic reticulum export factor | 253 | NM_033127 | −0.11189 |
| 69 | THNSL2 | threonine synthase like 2 | 271 | NM_018271 | SLC16A1 | solute carrier family 16 member 1 | 264 | NM_003051 | 0.103801 |
| 70 | ZNF608 | zinc finger protein 608 | 129 | NM_020747 | SLC16A1 | solute carrier family 16 member 1 | 264 | NM_003051 | 0.08092 |
| 71 | TBX6 | T-box transcription factor 6 | 335 | NM_004608 | SLC7A2 | solute carrier family 7 member 2 | 336 | NM_003046 | 0.086846 |
| 72 | ST3GAL5 | ST3 beta-galactoside alpha-2,3-sialyltransferase 5 | 337 | NM_003896 | SPOCD1 | SPOC domain containing 1 | 103 | NM_144569 | −0.05616 |
| 73 | TNS1 | tensin 1 | 338 | NM_022648 | SPOCD1 | SPOC domain containing 1 | 103 | NM_144569 | −0.06327 |
| | | | | | Intercept | | | | −2.78005 |

*Each GenBank Accession Number is a representative or exemplary GenBank Accession Number for the listed gene and is herein incorporated by reference in its entirety for all purposes. Further, each listed representative or exemplary accession number should not be construed to limit the claims to the specific accession number.

TABLE 5

Gene Centroids of 60 Classifier Biomarkers for the Bladder Cancer Subtypes

| Gene Symbol | Gene Name | I (Luminal) | II (Luminal Infiltrated) | III (Basal) | IV (Neuronal/Basal Infiltrated) | SEQ ID NO: | GenBank Accession Number* |
|---|---|---|---|---|---|---|---|
| ALDH1L2 | aldehyde dehydrogenase 1 family member L2 | −2.95 | 0.51 | 0.59 | 1.31 | 339 | NM_001034173 |
| ANXA6 | annexin A6 | −2.00 | 0.64 | 0.09 | 1.66 | 340 | NM_001155 |
| ARSI | arylsulfatase family member I | −3.67 | 0.42 | 1.72 | 1.23 | 341 | NM_001012301 |
| BCAS1 | breast carcinoma amplified sequence 1 | 1.88 | 1.10 | −3.83 | −5.58 | 342 | NM_003657 |
| BNC1 | basonuclin 1 | −1.48 | −0.57 | 7.97 | 2.24 | 343 | NM_001717 |
| C10orf99 | chromosome 10 open reading frame 99 | 1.69 | 1.15 | −1.26 | −7.80 | 344 | NM_207373 |
| C17orf28 | HID 1 domain containing | 0.80 | 0.61 | −3.52 | −2.18 | 345 | NM_030630 |
| CAPN5 | calpain 5 | 1.17 | 1.17 | −2.49 | −1.86 | 346 | NM_004055 |
| CCDC80 | coiled-coil domain containing 80 | −3.08 | 1.14 | 0.43 | 1.87 | 347 | NM_199511 |
| COL6A2 | collagen type VI alpha 2 chain | −2.25 | 1.10 | 0.36 | 2.02 | 348 | NM_058174 |
| CPXM2 | carboxypeptidase X, M14 family member 2 | −2.14 | 1.78 | −0.13 | 1.70 | 349 | NM_198148 |
| CTHRC1 | collagen triple helix repeat containing 1 | −3.30 | 0.61 | 0.64 | 1.15 | 350 | NM_138455 |
| DSG3 | desmoglein 3 | −2.16 | −1.59 | 7.87 | −1.24 | 351 | NM_001944 |
| EMILIN1 | elastin microfibril interfacer 1 | −1.96 | 1.86 | −0.20 | 1.84 | 352 | NM_007046 |
| EPN3 | epsin 3 | 0.61 | 0.45 | −0.73 | −2.60 | 353 | NM_017957 |
| EVPL | envoplakin | 0.51 | 0.48 | −0.65 | −2.53 | 314 | NM_001320747 |

TABLE 5-continued

Gene Centroids of 60 Classifier Biomarkers for the Bladder Cancer Subtypes

| Gene Symbol | Gene Name | I (Luminal) | II (Luminal Infiltrated) | III (Basal) | IV (Neuronal/Basal Infiltrated) | SEQ ID NO: | GenBank Accession Number* |
|---|---|---|---|---|---|---|---|
| FAP | fibroblast activation protein alpha | −3.87 | 0.94 | 0.84 | 1.46 | 289 | NM_004460 |
| FBN1 | fibrillin 1 | −2.47 | 1.02 | 0.22 | 1.82 | 354 | NM_000138 |
| FGF7 | fibroblast growth factor 7 | −2.23 | 1.98 | 0.12 | 1.44 | 355 | NM_002009 |
| FMO9P | flavin containing monooxygenase 9 pseudogene | 2.37 | 3.22 | −3.99 | −5.26 | 356 | NR_002925 |
| FNDC1 | fibronectin type III domain containing 1 | −4.02 | 2.05 | 0.42 | 2.44 | 357 | NM_032532 |
| GABBR2 | gamma-aminobutyric acid type B receptor subunit 2 | 0.63 | 5.25 | −2.87 | −0.72 | 358 | NM_005458 |
| GFPT2 | glutamine-fructose-6-phosphate transaminase 2 | −4.37 | 0.83 | 0.74 | 1.95 | 359 | NM_005110 |
| GGT6 | gamma-glutamyltransferase 6 | 1.18 | 0.33 | −2.23 | −5.61 | 360 | NM_001122890 |
| GREM1 | gremlin 1, DAN family BMP antagonist | −5.82 | 1.63 | 0.66 | 0.50 | 361 | NM_013372 |
| GRHL3 | grainyhead like transcription factor 3 | 1.02 | 1.46 | −1.39 | −6.23 | 362 | NM_021180 |
| IL20RB | interleukin 20 receptor subunit beta | -0.89 | −0.97 | 4.28 | −0.59 | 363 | NM_144717 |
| KRT6A | keratin 6A | −2.15 | −2.48 | 7.61 | −0.59 | 364 | NM_005554 |
| KRT6B | keratin 6B | −1.53 | −2.24 | 7.55 | −0.39 | 365 | NM_005555 |
| KRT6C | keratin 6C | −1.76 | −2.57 | 7.25 | −1.05 | 366 | NM_173086 |
| LMOD1 | leiomodin 1 | −1.31 | 2.77 | −0.22 | 0.96 | 367 | NM_012134 |
| LOC100188947 | HECTD2 antisense RNA 1 | 3.20 | 2.48 | −3.88 | −4.38 | 368 | NR_024467 |
| MR VI1 | murine retrovirus integration site 1 homolog | −1.19 | 1.65 | −0.15 | 0.54 | 369 | NM_001098579 |
| NRP2 | neuropilin 2 | −2.34 | 0.40 | 0.62 | 1.43 | 370 | NM_201266 |
| PDLIM3 | PDZ and LIM domain 3 | −2.49 | 1.95 | 0.33 | 1.51 | 371 | NM_014476 |
| PLA2G4F | phospholipase A2 group IVF | 1.13 | 0.24 | −0.66 | −4.12 | 372 | NM_213600 |
| PODN | podocan | -1.54 | 1.82 | -0.72 | 1.20 | 373 | NM_153703 |
| POSTN | periostin | −4.38 | 1.37 | 0.46 | 1.42 | 374 | NM_006475 |
| PRRX1 | paired related homeobox 1 | −3.33 | 0.94 | 0.50 | 2.06 | 331 | NM_006902 |
| PVRL4 | nectin cell adhesion molecule 4 | 0.49 | 0.36 | −0.39 | −2.97 | 375 | NM_030916 |
| RAPGEFL1 | Rap guanine nucleotide exchange factor like 1 | 1.01 | 0.10 | −0.43 | −3.66 | 376 | NM_001303533 |
| RHOU | ras homolog family member U | 0.59 | 1.22 | −2.78 | −1.70 | 377 | NM_021205 |
| RHOV | ras homolog family member V | −0.17 | 0.20 | 0.89 | −2.93 | 378 | NM_133639 |
| SCUBE2 | signal peptide, CUB domain and EGF like domain containing 2 | 1.29 | 3.00 | −3.51 | −1.86 | 282 | NM_020974 |
| SDC1 | syndecan 1 | 0.39 | 0.13 | −0.01 | −2.41 | 379 | NM_001006946 |
| SERPINB13 | serpin family B member 13 | −0.64 | −2.10 | 5.68 | −2.94 | 380 | NM_001307923 |
| SFRP2 | secreted frizzled related protein 2 | −6.65 | 2.50 | 0.68 | 1.68 | 381 | NM_003013 |
| SFRP4 | secreted frizzled related protein 4 | −5.67 | 3.09 | 0.38 | 2.19 | 382 | NM_003014 |
| SLC30A2 | solute carrier family 30 member 2 | 2.17 | 3.26 | −4.60 | −3.18 | 383 | NM_001004434 |

TABLE 5-continued

Gene Centroids of 60 Classifier Biomarkers for the Bladder Cancer Subtypes

| Gene Symbol | Gene Name | I (Luminal) | II (Luminal Infiltrated) | III (Basal) | IV (Neuronal/Basal Infiltrated) | SEQ ID NO: | GenBank Accession Number* |
|---|---|---|---|---|---|---|---|
| SMOC2 | SPARC related modular calcium binding 2 | −1.41 | 2.14 | −0.44 | 1.00 | 384 | NM_022138 |
| SNX31 | sorting nexin 31 | 1.40 | 2.05 | −6.48 | −7.24 | 385 | NM_152628 |
| SPRR2A | small proline rich protein 2A | −1.49 | −0.32 | 5.64 | −1.95 | 386 | NM_005988 |
| SSC5D | scavenger receptor cysteine rich family member with 5 domains | −2.38 | 1.82 | 0.09 | 1.78 | 387 | NM_001144950 |
| TBX3 | T-box 3 | 1.48 | 0.55 | −3.24 | −2.08 | 388 | NM_005996 |
| TLE2 | transducin like enhancer of split 2 | 0.96 | 0.69 | −2.92 | −1.06 | 389 | NM_003260 |
| TOX3 | TOX high mobility group box family member 3 | 2.44 | 2.08 | −6.52 | −5.74 | 390 | NM_001080430 |
| UPK1A | uroplakin 1A | 1.94 | 2.82 | −5.92 | −6.97 | 391 | NM_007000 |
| UPK2 | uroplakin 2 | 1.85 | 2.45 | −5.94 | −6.04 | 233 | NM_006760 |
| UPK3A | uroplakin 3A | 1.88 | 3.61 | −5.65 | −4.89 | 392 | NM_006953 |
| ZNF750 | zinc finger protein 750 | −0.07 | 0.52 | 0.82 | −3.97 | 393 | NM_024702 |

*Each GenBank Accession Numer is a representative or exemplary GenBank Accession Number for the listed gene and is herein incorporated by reference in its entirety for all purposes. Further, each listed representative or exemplary accession number should not be construed to limit the claims to the specific accession number.

Example 3—Use Fibroblast Growth Factor Receptor 3 (FGFR3) Activation Signatures to Determine Drug Sensitivity Objective This example was initiated to determine the utility of each of the FGFR3 Activation Signatures (i.e., FAS-1, FAS-2, FAS-3 and FAS-4) for predicting sensitivity of samples from known cancer patients to specific FGFR3 inhibitors.

Materials and Methods

In order to assess the ability of each of the FGFR3 activation signatures described in Examples 1 and 2 to determine or predict FGFR3 inhibitor sensitivity, the correlation between each of the FGFR3 activation signatures and activity of known FGFR3 inhibitory agents was determined.

Data Sources

The above-mentioned correlations were performed on expression data from both microarray and RNA-seq platforms. In particular, RNA-seq based bladder cancer cell line expression (CCLE) and tumor type data was obtained from the Sanger and Broad institutes (i.e., //cellmodelpassports.sanger.ac.uk/downloads), while microarray expression data using the Affymetrix Human Genome U219 array was obtained from the Wellcome Sanger Institute database (i.e., www.cancerrxgene.org). For the RNA-seq data, the data sources used were the FPKM data (i.e., rnaseq_2019-04-15_1133.csv.gz and gene_identifiers_2019-02-19_1024.csv.gz) and the cancer type (i.e., model_list_2019-06-21_1535.csv.gz). The FPKM file annotates profiles to Sanger (CCLE: RNASeq n=447, ngenes=35004) and to Broad (CCLE: RNASeq n=706, n genes=37260) with 72 cell lines in both, of which, there were a total of 20 bladder cancer cell lines (n=5 for Broad and 18 for Sanger with three (3) being present in both). The Sanger array expression data contained expression data for about 10 k genes from nineteen (19) bladder cancer cell lines.

The drug sensitivity data used for this study included two (2) IC50 data sets (i.e., GDSC1 (earlier) and GDSC2 (later)) from the Wellcome Sanger Institute database (i.e., www.cancerrxgene.org/downloads/bulk_download).

Association Between Signatures and Drug Sensitivity

Figure 13:
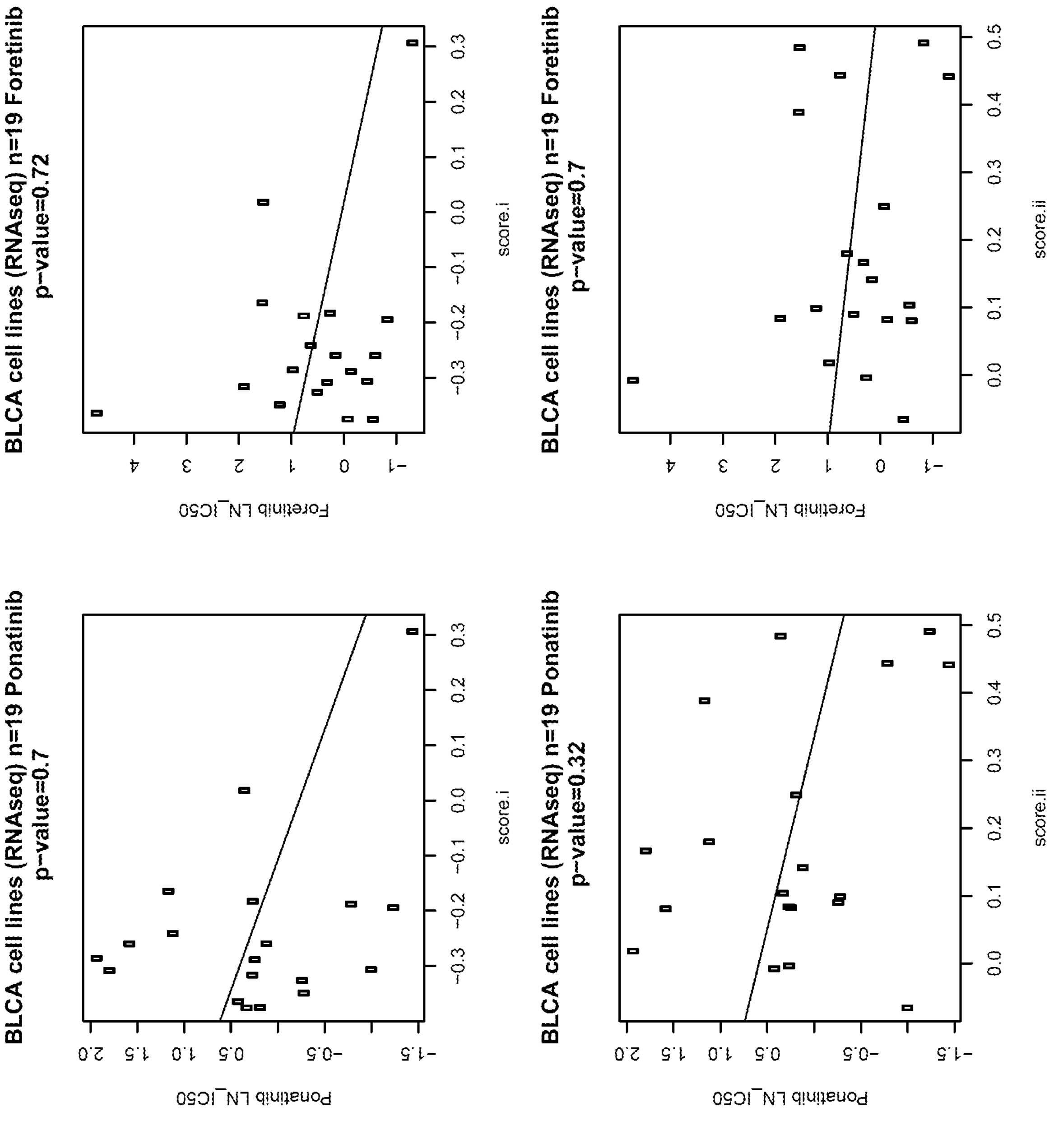
FIG. 13 illustrates the association between the IC50 for specific FGFR3 inhibitors (i.e., Ponatinib, Foretinib, BIBF and PD173074) from the Sanger GDSC1 data set and score using FAS-1 (top row, score i) or FAS-2 (bottom row, score ii).
Figure 13:
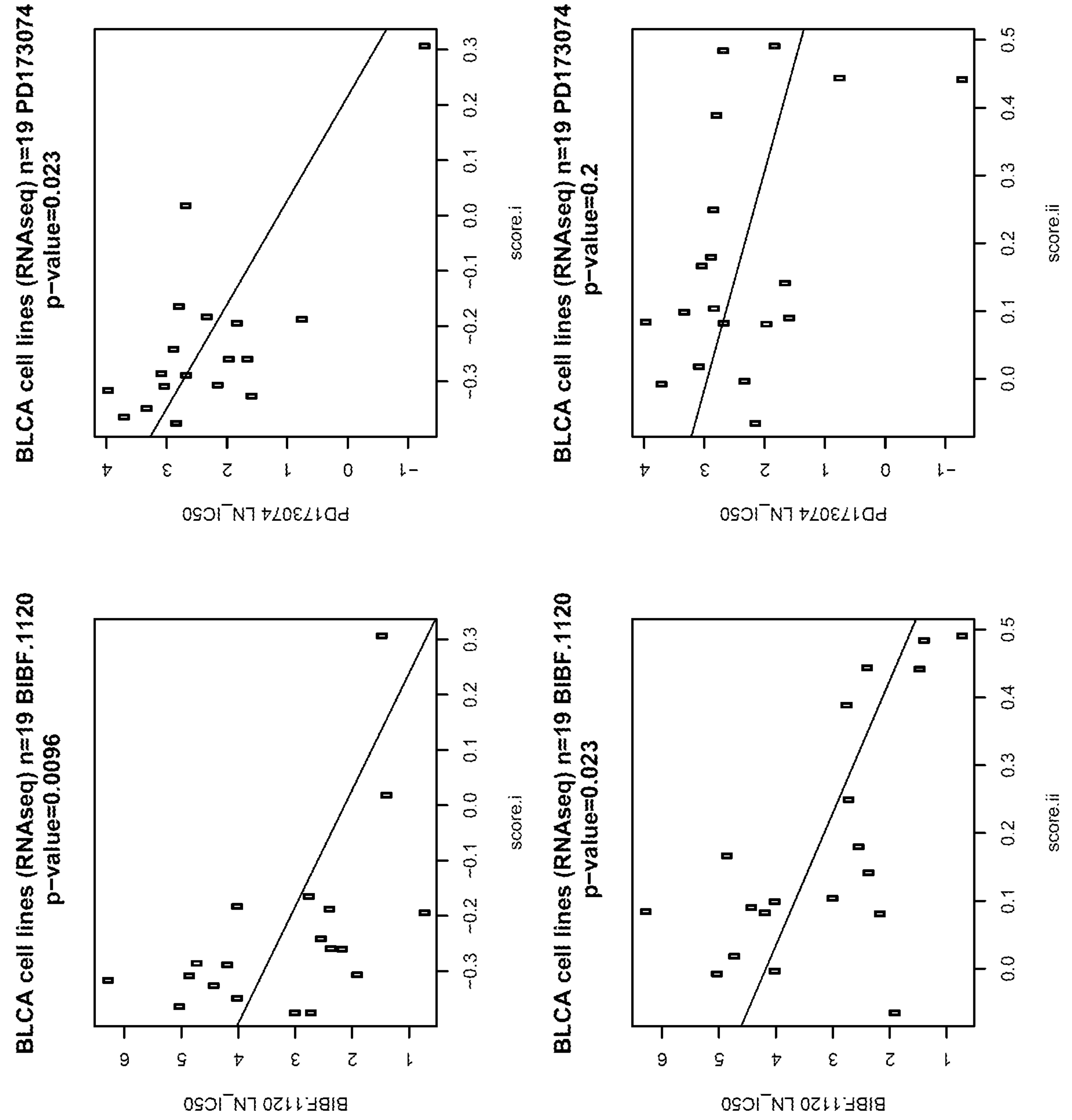
Figure 14:
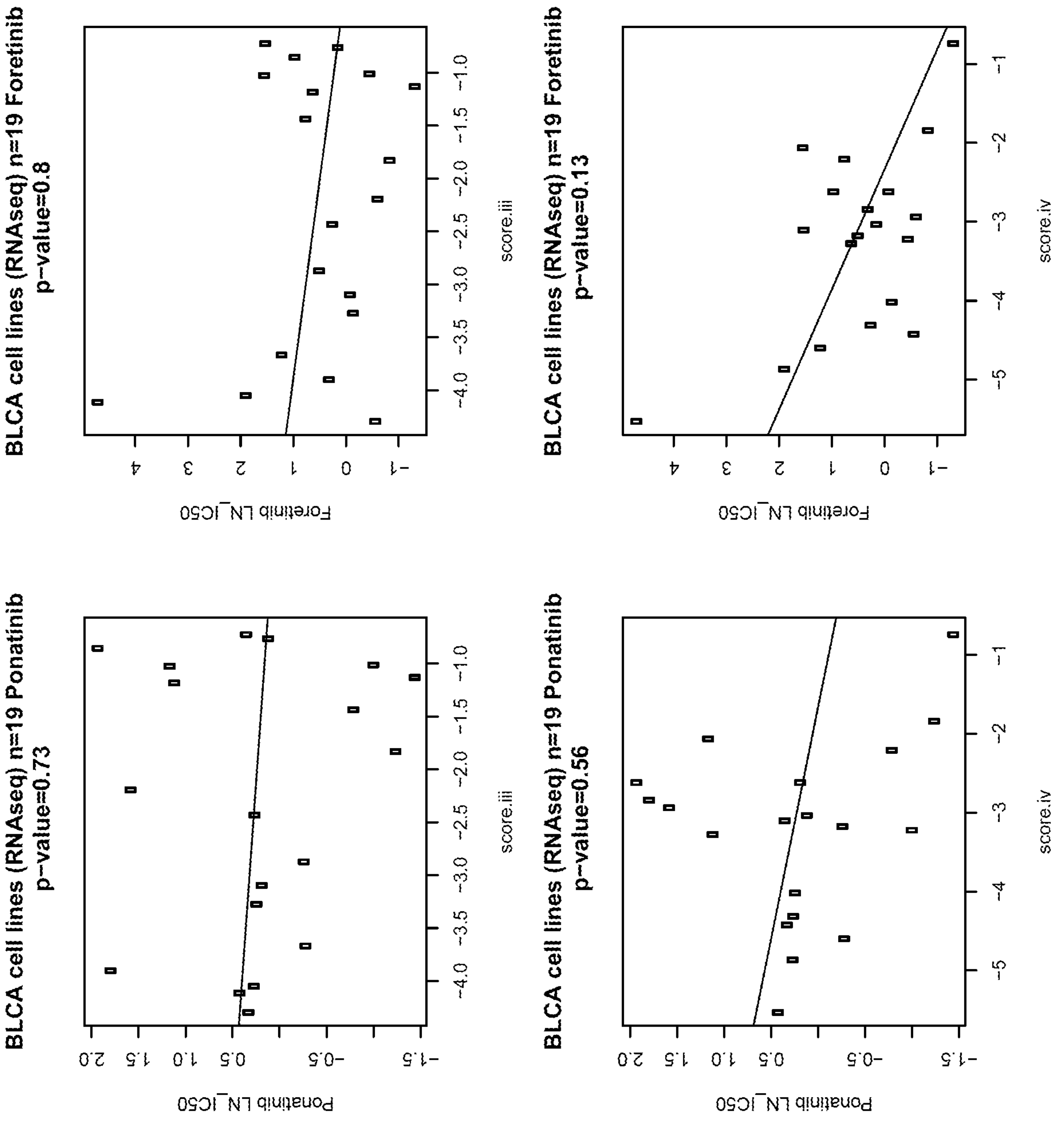
FIG. 14 illustrates the association between the IC50 for specific FGFR3 inhibitors (i.e., Ponatinib, Foretinib, BIBF and PD173074) from the Sanger GDSC1 data set and score using FAS-3 (top row, score iii) or FAS-4 (bottom row, score iv).
Figure 14:
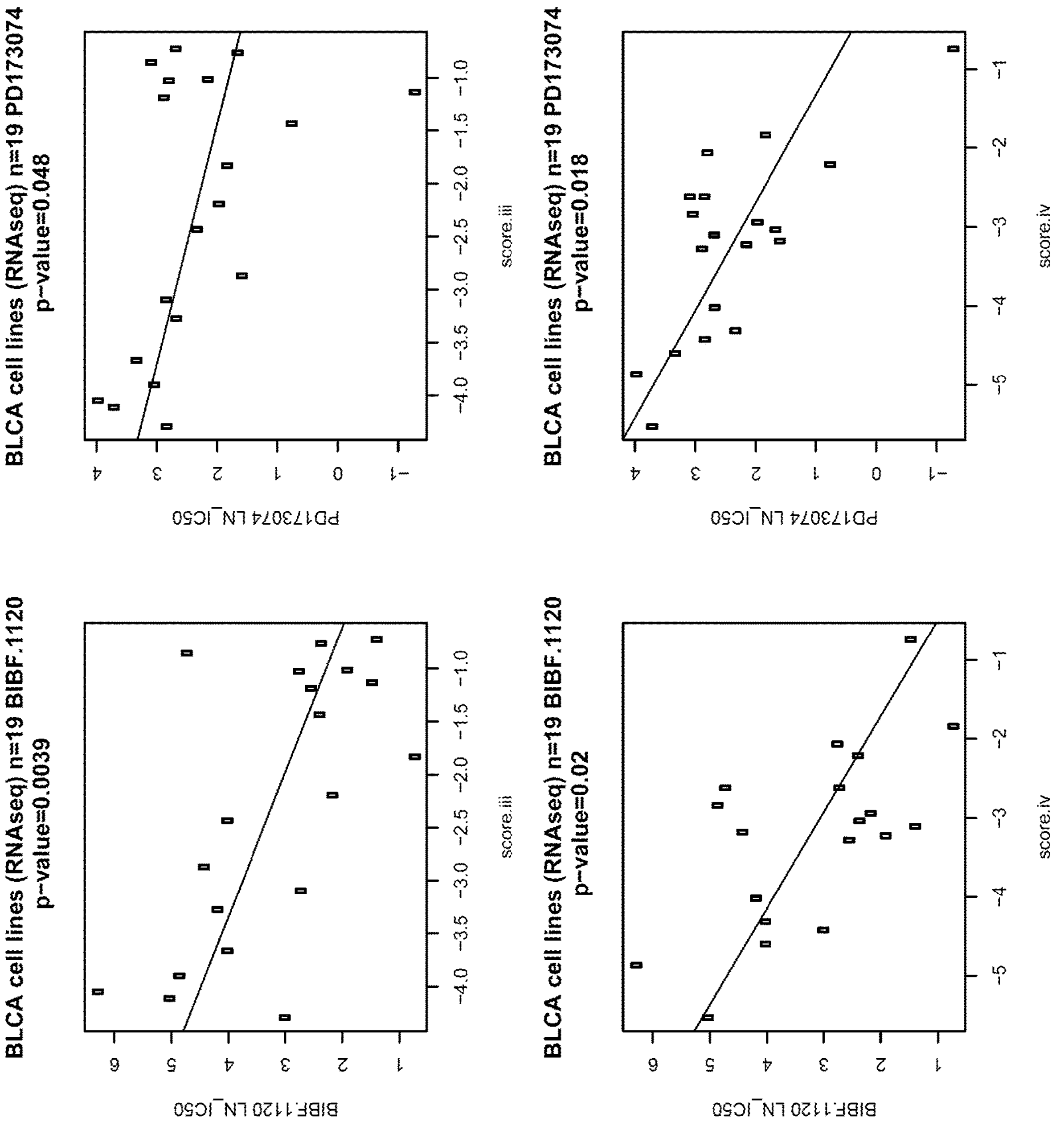
Figure 15:
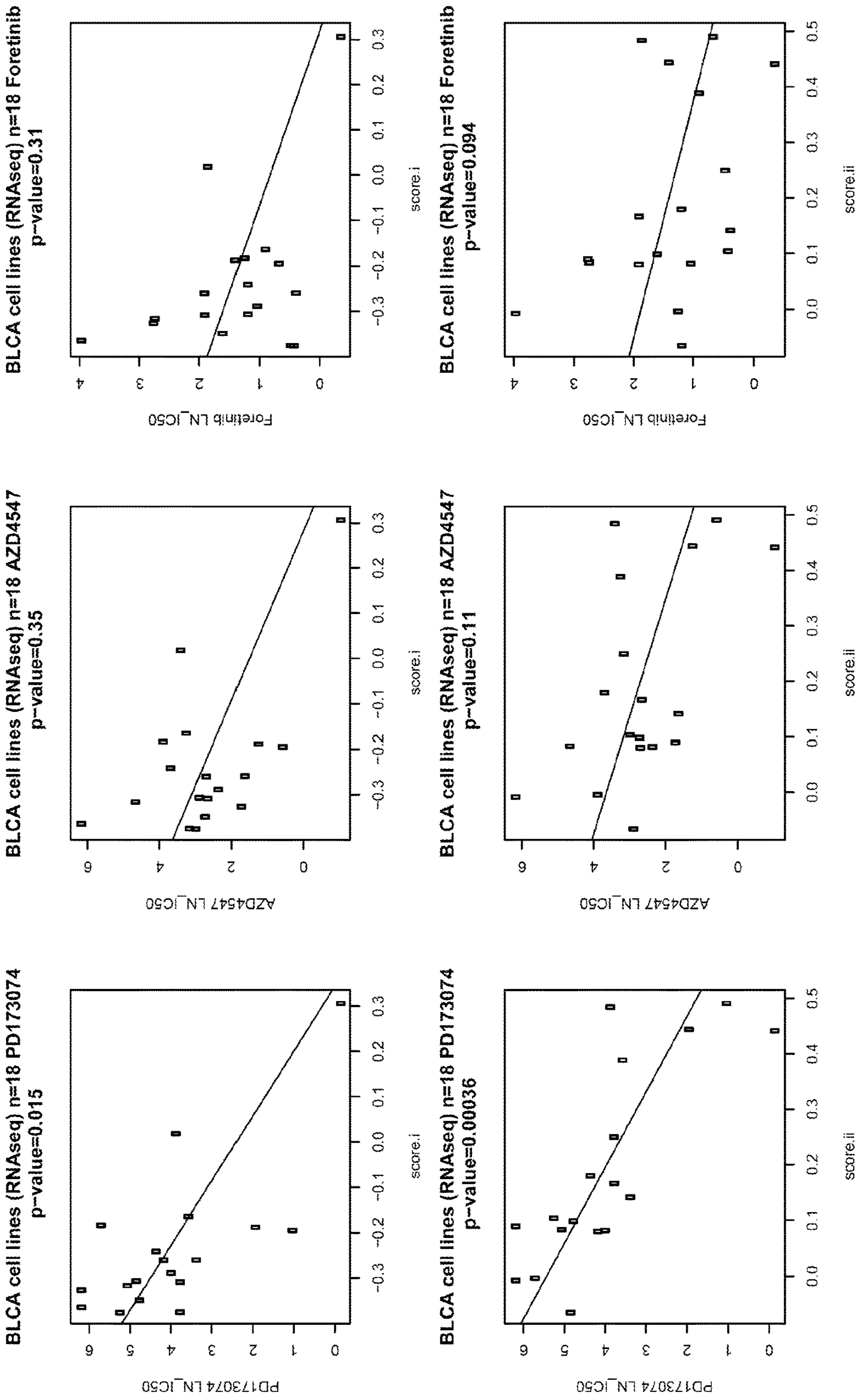
FIG. 15 illustrates the association between the IC50 for specific FGFR3 inhibitors (i.e., Foretinib, AZD4547 and PD173074) from the Sanger GDSC2 data set and score using FAS-1 (top row, score i) or FAS-2 (bottom row, score ii).
Figure 16:
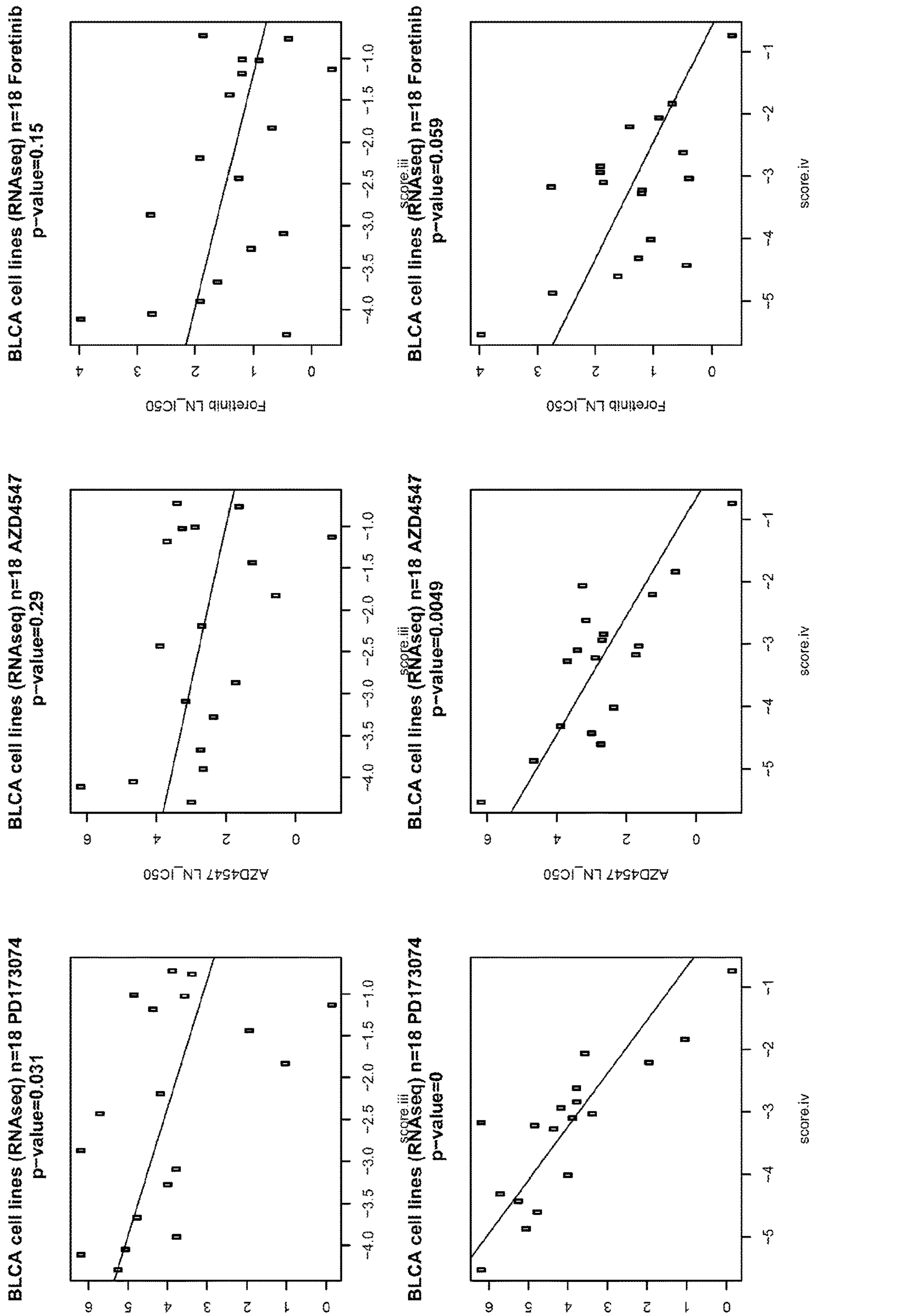
FIG. 16 illustrates the association between the IC50 for specific FGFR3 inhibitors (i.e., Foretinib, AZD4547 and PD173074) from the Sanger GDSC2 data set and score using FAS-3 (top row, score iii) or FAS-4 (bottom row, score iv).

To determine the presence of an association between each of the FGFR3 activation signatures and sensitivity to specific FGFR3 inhibitors in the RNA-seq dataset, data from all available bladder cell lines with expression data and drug sensitivity data were used to make plots for relevant drugs from the GDSC1 data set (see FIG. 13 (FAS-1 on the top row and FAS-2 on the bottom row) and FIG. 14 (FAS-3 on the top row and FAS-4 on the bottom row)) and the GDSC2 data set (see FIG. 15 (FAS-1 on the top row and FAS-2 on the bottom row) and FIG. 16 (FAS-3 on the top row and FAS-4 on the bottom row)). IC50 values for each of the four drugs from the dataset with known FGFR inhibitor activity were plotted against the signature scores with p-values for the correlation (Pearson Correlation) between the parameters noted. The signature scores represented the FGFR3 mutational status for each cell line, which was determined by applying each of FAS 1-4 to the expression data for the cell lines as described in Examples 1 and 2. A negative correlation (i.e., lower IC50 value combined with higher signature score) demonstrated an FGFR3 activation signature identifying drugs with higher FGFR3 inhibitory activity. The score on the X-axis for FAS-1 (i.e., score i in FIGS. 13, 15 and 17) and FAS-2 (i.e., score ii in FIGS. 13, 15 and 18) represents the correlation coefficient between each sample and the altered (i.e., "Yes") centroid in the respective FAS. The score on the X-axis for FAS-3 (i.e., score iii in FIGS. 14, 16 and 17) and FAS-2 (i.e., score iv in FIGS. 14, 16 and 18) is the (d) calculated for each sample using Equation 1 in conjunction with the expression data from each of the gene pairs for the respective FAS.

Figure 17:
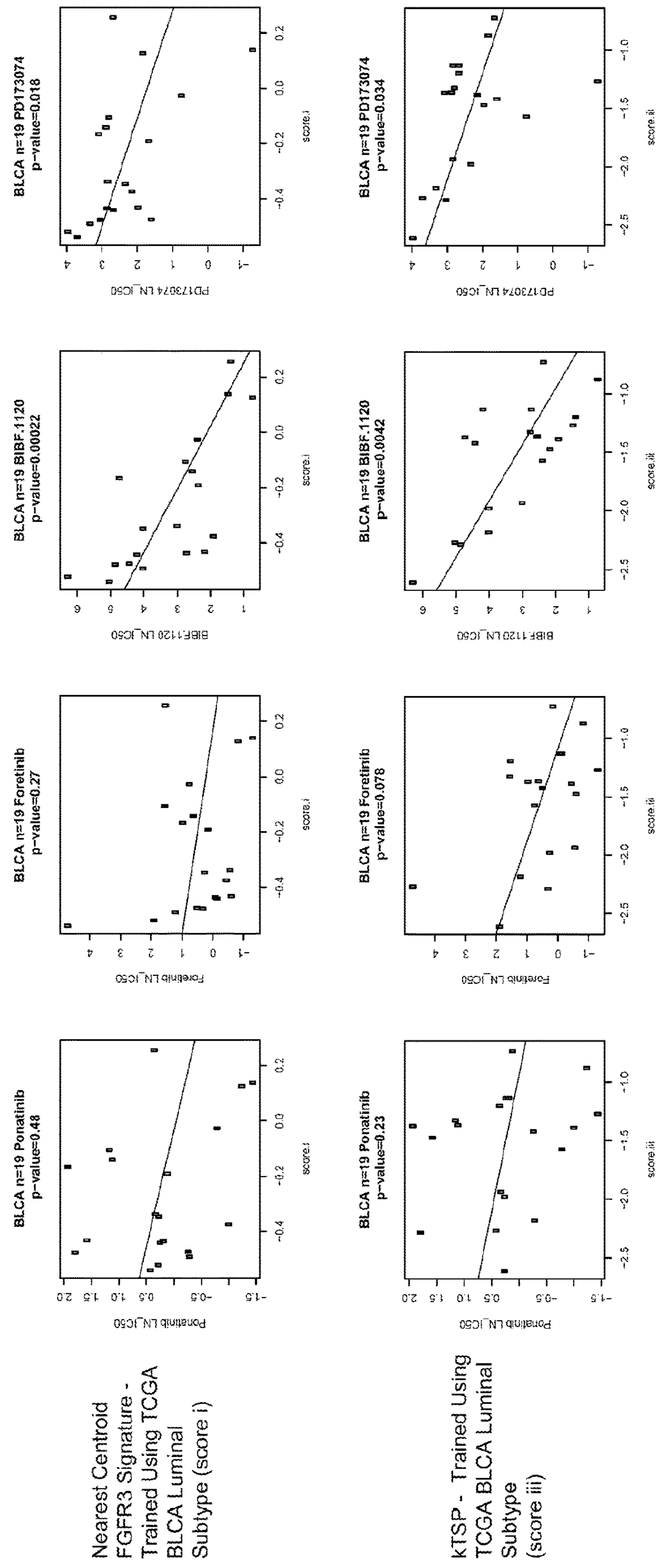
FIG. 17 illustrates the association between the IC50 for specific FGFR3 inhibitors (i.e., Ponatinib, Foretinib, BIBF and PD173074) from the Sanger Affymetrix Human Genome U219 array data set and score using FAS-1 (top row, score i) or FAS-3 (bottom row, score iii).
Figure 18:
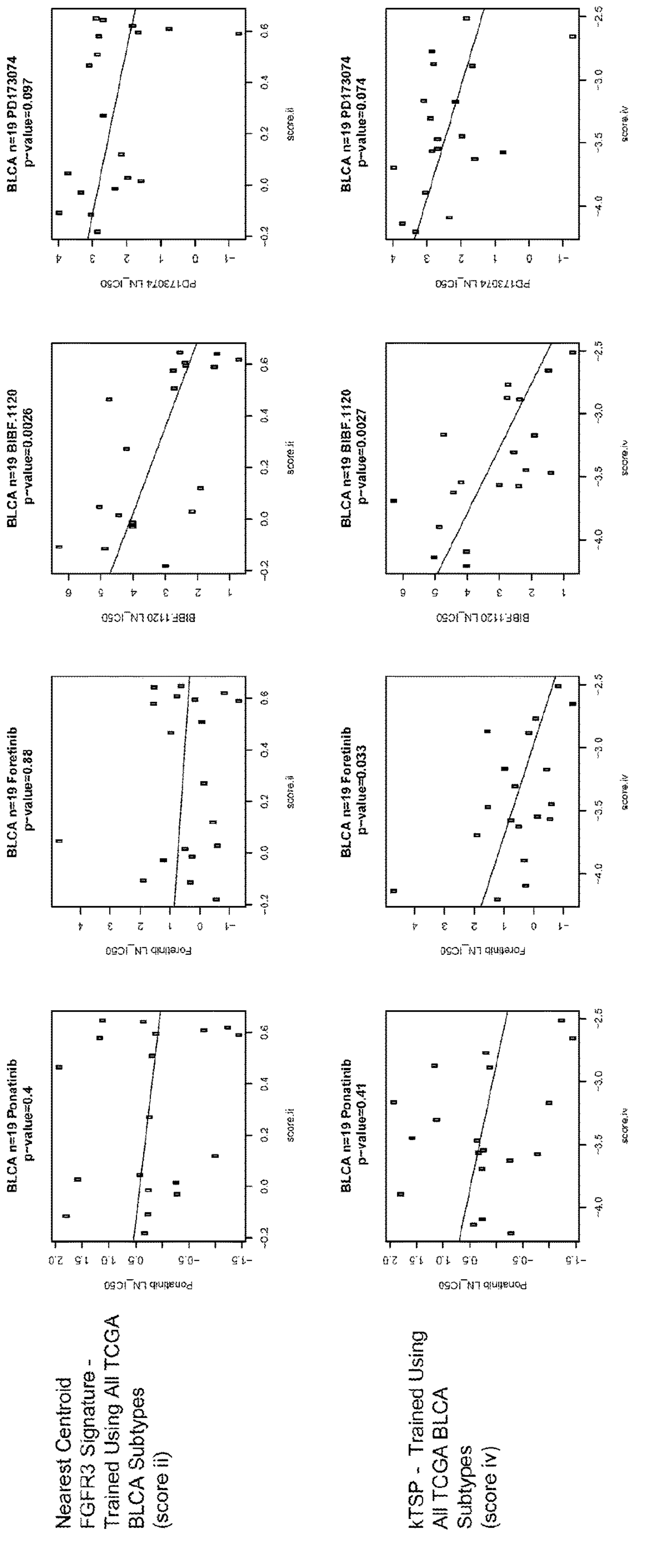
FIG. 18 illustrates the association between the IC50 for specific FGFR3 inhibitors (i.e., Ponatinib, Foretinib, BIBF and PD173074) from the Sanger Affymetrix Human Genome U219 array data set and score using FAS-2 (top row, score ii) or FAS-4 (bottom row, score iv).
Figure 19:
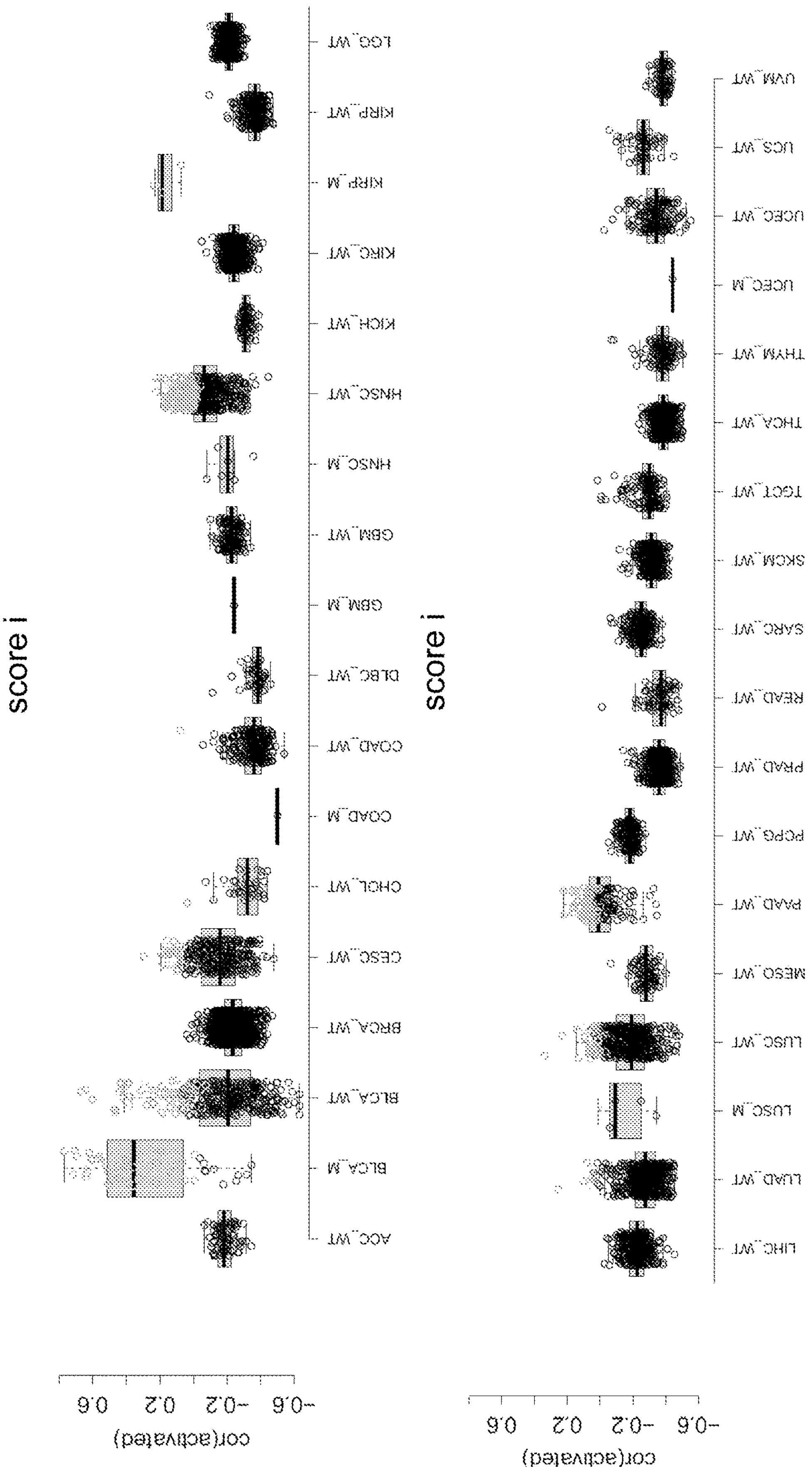
FIG. 19 illustrates the assessment of the FGFR3 activation status across numerous tumor types using the nearest centroid FGFR3 activation signature of Table 1. FAS (+) tumors are shown as gray. M=mutation or fusion (aka Altered); WT=non-mutated/wild type. It is noted that not all tumor types have FGFR3 mutations present.
Figure 20:
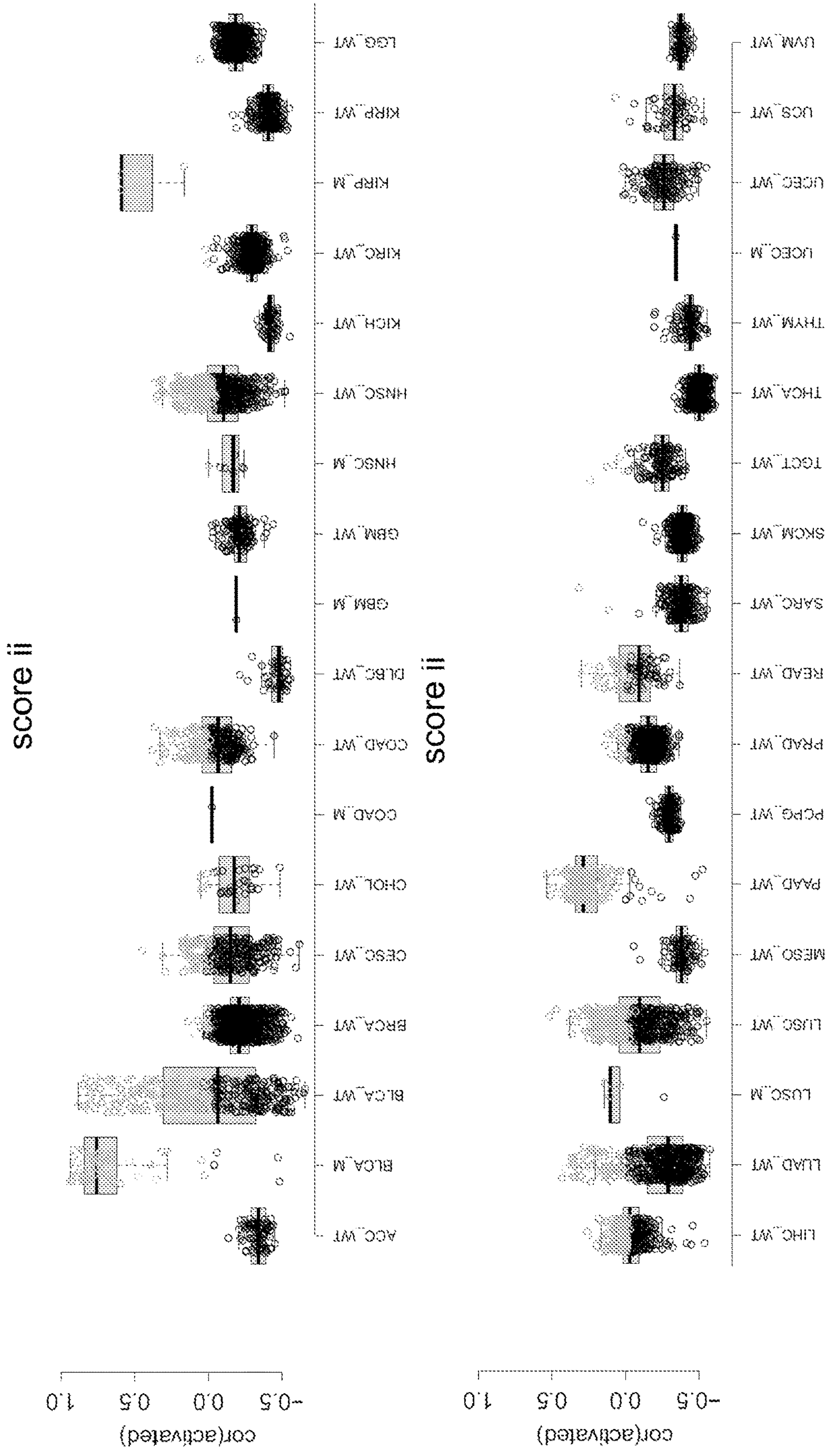
FIG. 20 illustrates the assessment of the FGFR3 activation status across numerous tumor types using the nearest centroid FGFR3 activation signature of Table 2. FAS (+) tumors are shown as gray. M=mutation or fusion (aka Altered); WT=non-mutated/wild type. It is noted that not all tumor types have FGFR3 mutations present.
Figure 21:
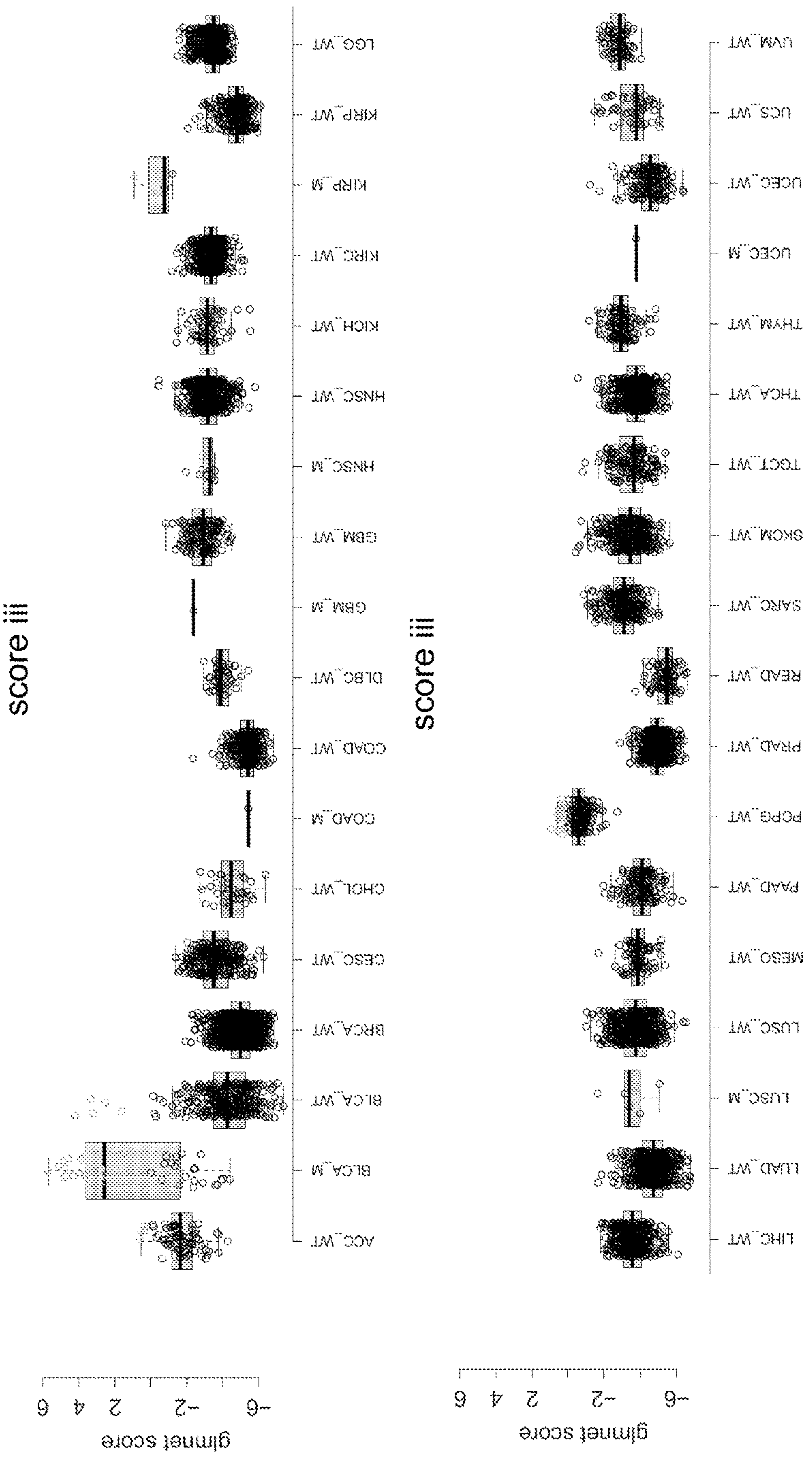
FIG. 21 illustrates the assessment of the FGFR3 activation status across numerous tumor types using the k-top scoring pairs (kTSP) FGFR3 activation signature of Table 3. FAS (+) tumors are shown as gray. M=mutation or fusion (aka Altered); WT=non-mutated/wild type. It is noted that not all tumor types have FGFR3 mutations present.
Figure 22:
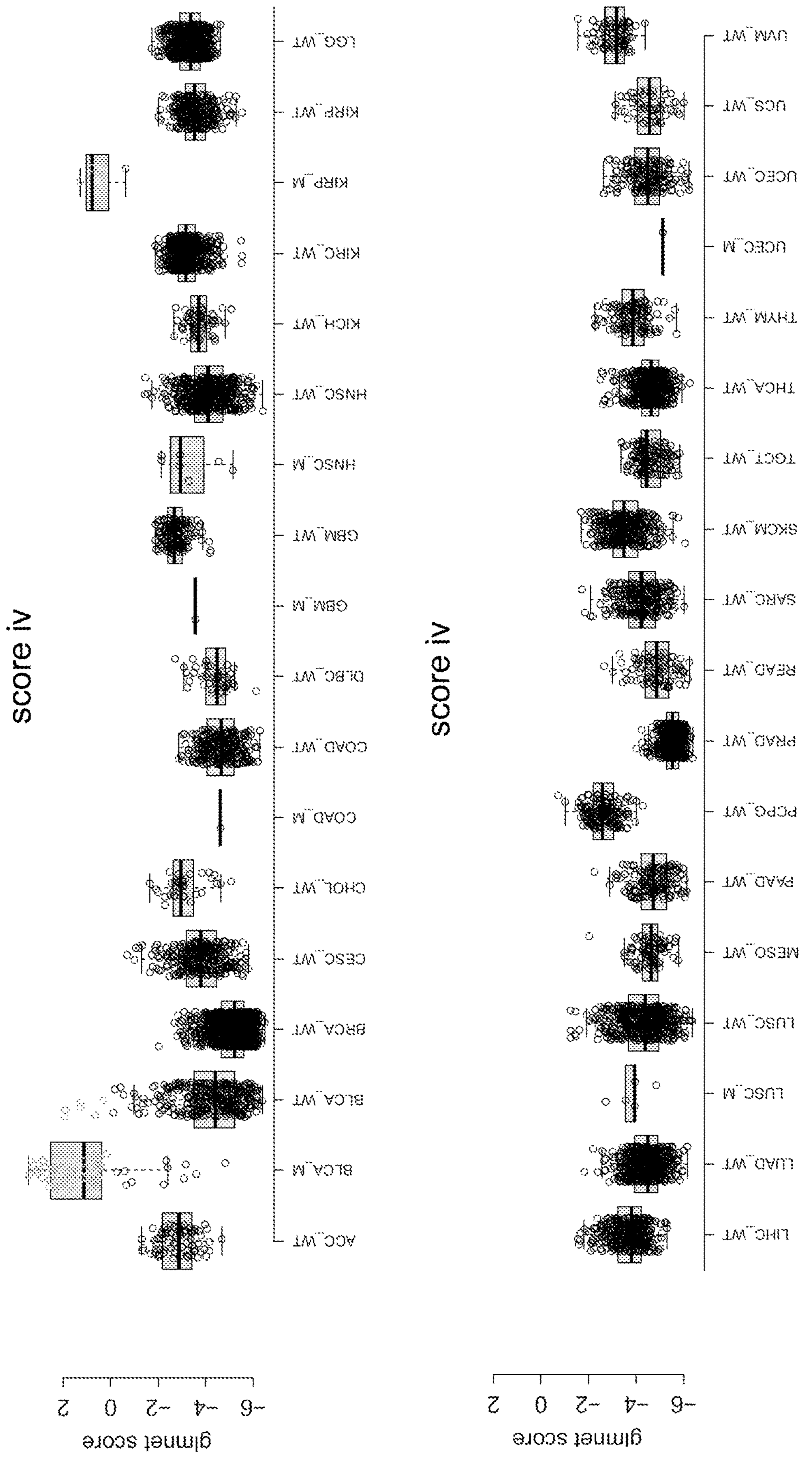
FIG. 22 illustrates the assessment of the FGFR3 activation status across numerous tumor types using the k-top scoring pairs (kTSP) FGFR3 activation signature of Table 4. FAS (+) tumors are shown as gray. M=mutation or fusion (aka Altered); WT=non-mutated/wild type. It is noted that not all tumor types have FGFR3 mutations present.

Similarly for the microarray based data set, associations between each of the FGFR3 activation signatures and sensitivity to specific FGFR3 inhibitors were determined by using data from all available bladder cell lines with expression data and drug sensitivity data to make plots for relevant drugs (see FIG. 17 (FAS-1 on top row and FAS-3 on bottom row) and FIG. 18 (FAS-2 on top row and FAS-4 on bottom row)). The signature scores represented the FGFR3 mutational status for each cell line, which was determined by applying each of FAS 1-4 to the expression data for the cell lines as described in Examples 1 and 2.

Results and Conclusions

As can be seen in FIGS. 13-18, each of the FGFR3 activation signatures were effective in identifying tumor samples that showed sensitivity to certain FGFR3 inhibitors vs. others regardless of platform used to obtain expression data. Moreover, specific inhibitors (e.g., BIBF and foretinib) that showed samples with sensitivity were consistent across each activation signature and across expression platforms. It is noted that each of the FAS classifiers were particularly effective in identifying samples (i.e., altered) that showed high sensitivity (i.e., low IC50 values) for an inhibitor known to show FGFR3 inhibitory activity specifically (i.e., BIBF 1120 or Nintedanib). This served as proof of principle of utility of the generated activation signatures.

Example 4—the Selection of Tumor Samples Across Cancer Types that May be Susceptible to FGFR Inhibition by Using Fibroblast Growth Factor Receptor 3 (FGFR3) Activation Signatures Instead of FGFR3 Mutation Status Objective This example was initiated to determine the utility of each of the FGFR3 Activation Signatures (i.e., FAS-1, FAS-2, FAS-3 and FAS-4) for predicting an active FGFR3 pathway across numerous cancer types that may or may not be identified by FGFR3 mutation status. In summary, the activation signatures and the categorization methods developed and described in Examples 1 and 2 were applied to samples from numerous cancer types (e.g., ACC, BLCA, BRCA, CESC, CHOL, COAD, DLBC, GBM, HNSC, KICH, KIRC, KIRP, LGG, LIHC, LUAD, LUSC, MESO, PAAD, PCPG, PRAD, READ, SARC, SKCM, TGCT, THCA, THYM, UCEC, UCS and UVM) in order to categorize the samples into one of two categories-(1) FAS-positive or FAS (+) or (2) FAS negative or FAS (−). An FAS-positive determination using an FAS developed and described as provided herein for a sample is predictive for said sample containing FGFR3 oncogenic mutation(s), while an FAS negative determination for a sample is predictive for said sample not containing FGFR3 oncogenic mutation(s).

Materials and Methods

Data Sources

Expression data from the 2018 TCGA PanCancer publications were downloaded (gdc.cancer.gov/about-data/publications/pancanatlas). Expression profiles from primary solid tumor samples were used that had data from the "Illumina-HiSeq_RNASeqV2" platform and "do_not_use=False" specified in the sample quality file (merged_sample_quality_annotations.tsv).

Methods

Once downloaded, the gene expression values were log 2 transformed. The four (4) activation classifiers (i.e., FAS-1, -2, -3 or -4) were individually applied in the manner described elsewhere in this document (e.g., Examples 1 and 2), here using training set gene medians for centering values when applying classifiers FAS-1 and FAS-2. FGFR3 mutation status data associated with TCGA PanCancer Atlas studies (www.cbioportal.org/) was downloaded and any tumors from any specific cancer type with any mutations annotated "putative driver" were assigned to the mutant group (the_M groups in FIGS. 19-22) for that type of cancer, while any tumors from any specific cancer type that were not so annotated were assigned the wildtype group for that type of cancer. For classifier FAS-1, the correlation with the activated centroid (the activated-ness quantitative measurement) by TCGA tumor type (separately by FGFR3 mutant and wildtype when the study had both) were plotted. Tumors that were classified as FGFR-activated by FAS-1 using the ordinary decision method (here, for FAS-1, when the correlation with the activated centroid was greater than correlation with the not activated centroid) were colored shaded gray and otherwise black. Analysis was similar for the application of FAS-2, 3, 4.

Results and Conclusions

As can be seen in FIGS. 19-22, for BLCA and other tumor types there is an overlap of FGFR3 classifier active tumor and those that are considered to have an FGFR3 oncogenic mutation. There are other tumor types such as COAD, HNSC and LUSC, as demonstrated with FAS-2, that have minimal FGFR3 oncogenic mutations but have a significant number of tumors that are considered wild type but are considered FGFR3 classifier active (i.e., FAS (+)). Also, other tumor types such as LIHC, LUAD and PAAD had no FGFR3 oncogenic mutations present but had a significant number of tumors that are considered wild type but are also considered FGFR3 classifier active (i.e., FAS (+)). These results demonstrate that FAS 1-4 can provide the ability to select for tumors potentially susceptible to FGFR inhibition (e.g., via treatment with an FGFR3 inhibitor) by FGFR3 activation status that may or may not be captured using FGFR3 mutational status.

Example 5—Comparison of Progression Free Survival and Clinical Response by Fibroblast Growth Factor Receptor 3 (FGFR3) Activation Signature Status Vs. Conventional Alteration Status in Patients with Bladder Cancer Objective This example was initiated to compare the ability of an FGFR3 Activation Signature (i.e., FAS-1) to predict survival (progression free survival; PFS) to conventional FGFR3 alteration (mutation and/or fusion) status in a cohort of samples from bladder cancer (BLCA) patients. Furthermore, FGFR3 Activation Signature and conventional FGFR3 alteration status was also used to predict response to *Bacillus* Calmette-Guérin (BCG) therapy in the same cohort of patients. In particular, an examination of the PFS of BLCA patients treated with BCG was performed using either conventional FGFR3 DNA mutational/fusion analysis or FAS-1 developed in Example 1 as the means for predicting potential response to therapy, especially response to FGFR inhibition as demonstrated in Example 3.

Methods and Materials

RNAseq data and DNA alteration (mutations or fusion) data from a combination of SNaPshot DNA and RNAseq analysis, along with clinical response data were collected from a cohort of high-risk non-muscle invasive bladder cancer (HR-NMIBC) patients who received intravesical *Bacillus* Calmette-Guérin (BCG) therapy. All patients had a tumor stage of T1 prior to BCG treatment. Tumor progression was defined as any tumor recurrence (high grade recurrence or low-grade recurrence) at any time after completion of the initial BCG induction therapy—this includes any time during the BCG maintenance treatment phase and completion of BCG therapy. Progression Free Survival (PFS) was calculated as number of months from Start of BCG induction therapy, "Date_BCG_induc1", to time of tumor progression beyond T1 stage (i.e., T2, T3,T4), "Date_Prog". Patients with no tumor progression were censored using Date of Last Follow-up, "DLF". Clinical response to BCG treatment (e.g., BCG Failure "yes" vs "no") was compared to FGFR3 alteration status or activation signature status using Fisher's Exact test.

Results and Conclusions

Figure 23:
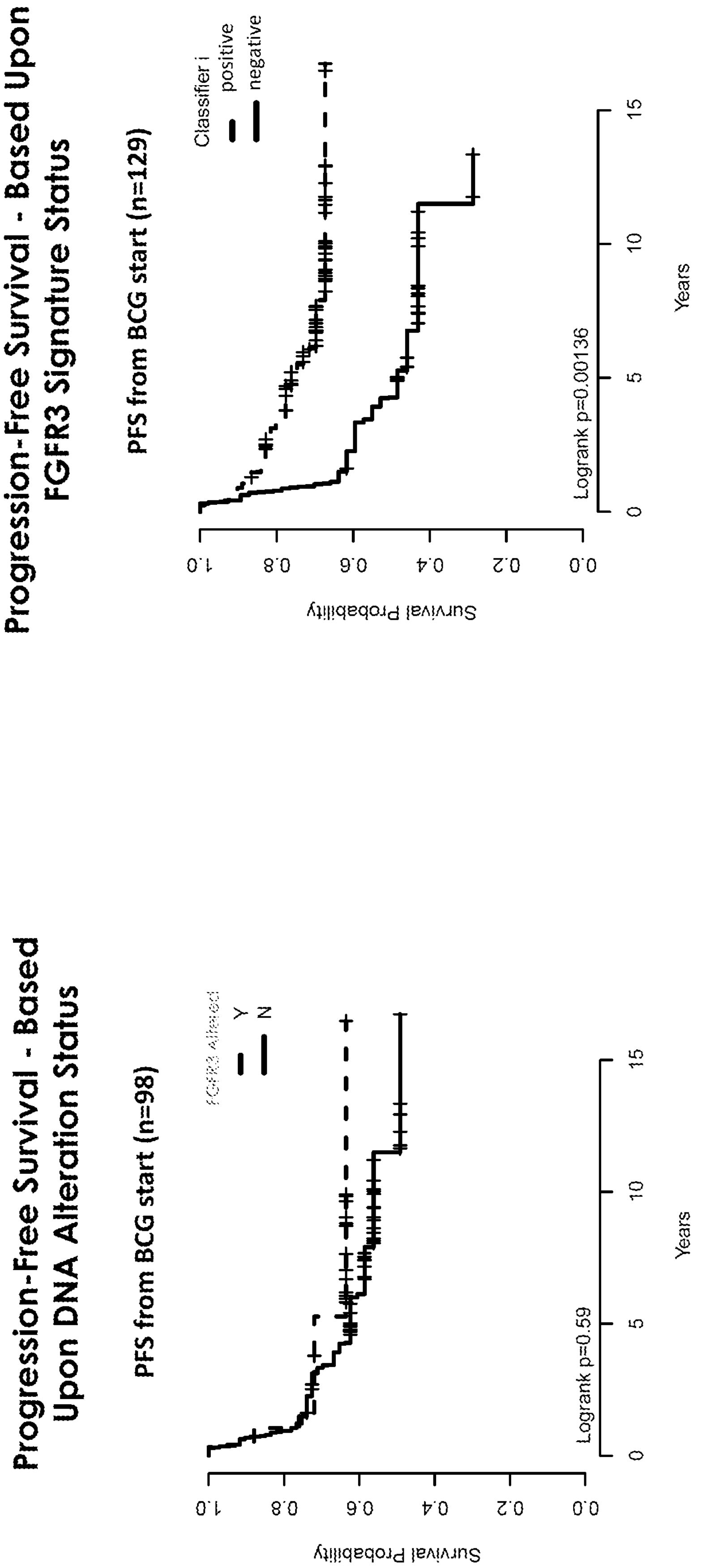
FIG. 23 illustrates the progression free survival (survival probability) in years of high-risk non-muscle invasive bladder cancer patients treated with BCG based upon an analysis of said patients' FGFR3 alteration status (via DNA testing) or FGFR3 activation status (via use of the nearest centroid FGFR3 activation signature of Table 1).

As can be seen in the graph on the left-side of FIG. 23, PFS in HR-NMIBC patients treated with BCG was not different when evaluated by conventional FGFR3 alteration status (FGFR3 altered Y or N; P=0.59 (i.e., NS)). Alternatively, when PFS was evaluated based upon FGFR3 Activation Signature status (e.g., FAS-1) as can be seen in the graph on the right-side of FIG. 23, there was a significant difference in PFS (P=0.001). More specifically, in the 98 patients represented in the graph on the left-side of FIG. 23, survival (e.g., PFS) did not appear to matter whether or not the patient's tumor was found to have an FGFR3 mutation or not. In contrast, when FGFR3 mutational status was assessed via use of FAS-1, the 129 patients represented in the graph on the right side of FIG. 23, a clear and significant differential survival (e.g., PFS) following BCG treatment became evident. Also, in this overlapping cohort of patients, 26% (25 of 98) of patients were determined to have alterations present via conventional assessment of FGFR3 DNA alteration status, whereas 64% (82 of 129) of patients with FGFR3 Activation Signature status were considered to be FAS-1 classifier positive via FGFR3 activation status assessment using FAS-1 as described previously herein.

As seen in FIG. 23 (continued), when evaluating clinical response to BCG treatment (BCG Failure "yes" vs. "no") instead of survival (e.g. PFS), there was no difference in BCG response when evaluated by FGFR3 alteration status (P=0.6 (i.e., NS)); however, there was a significant difference in BCG response by FGFR3 Activation Signature (P=0.006). Overall, these results demonstrate that FGFR3 Activation Signature status (e.g., FAS positive vs negative) differentiates both survival (e.g., PFS) and response to standard therapy (e.g., BCG) and may provide the ability to select patients amendable to treatment with an FGFR3 inhibitor (e.g., BIBF) as opposed to non-FGFR3 inhibitor treatment.

Numbered Embodiments of the Disclosure

Other subject matter contemplated by the present disclosure is set out in the following numbered embodiments:

1. A method of determining whether a patient suffering from cancer is likely to respond to treatment with an fibroblast growth factor receptor (FGFR) inhibitor, the method comprising,
   determining an FGFR3 activation signature of a sample obtained from a patient suffering from cancer; and
   based on the FGFR3 activation signature, assessing whether the patient is likely to respond to treatment with an FGFR inhibitor, wherein a positive FGFR3 activation signature indicates presence of one or more FGFR3 mutations and predicts that the patient is likely to respond to the treatment with the FGFR inhibitor.
2. A method for selecting a patient suffering from cancer for treatment with an FGFR inhibitor, the method comprising, determining an FGFR3 activation signature of a sample obtained from a patient suffering from cancer; and selecting the patient for treatment with an FGFR inhibitor if the FGFR3 activation signature is positive, wherein the positive FGFR3 activation signature indicates presence of one or more FGFR3 mutations.
3. The method of embodiment 1 or 2, wherein the FGFR inhibitor shows inhibitory activity toward fibroblast growth factor receptor-3 (FGFR3).
4. The method of any one of the above embodiments, wherein the FGFR inhibitor is a tyrosine kinase inhibitor.
5. The method of embodiment 4, wherein the FGFR inhibitor is a selective tyrosine kinase inhibitor.
6. The method of embodiment 4, wherein the FGFR inhibitor is a non-selective tyrosine kinase inhibitor.
7. The method of any one of the above embodiments, wherein the FGFR inhibitor is selected from the group consisting of erdafitinib (JNJ 42756493), infigratinib (BGJ398), Rogaritinib (BAY 1163877), AZD4547, Pemigatinib (INCB54828), TAS-120, LY2874455, DEBIO 1347, PD173074, BLU9931, pazopanib, brivanib, ponatinib (AP24534), regorafenib (BAY 73-4506), lenvatinib (E7080), dovitinib (TKI258), lucitanib (E3810), nintedanib (BIBF 1120), Foretinib, and any combination thereof.
8. The method of any one of the above embodiments, wherein the FGFR inhibitor is nintedanib (BIBF 1120).
9. The method of any one of embodiments 1-3, wherein the FGFR inhibitor is an antibody or antibody-conjugate.
10. The method of embodiment 9, wherein the FGFR inhibitor is B-701 or MFGR1877S.
11. The method of embodiment 9, wherein the FGFR inhibitor is LY3076226.
12. The method of any one of the above embodiments, wherein the cancer the patient is suffering from is selected from the group consisting of breast cancer (BRCA), pancreatic adenocarcinoma (PAAD), lung adenocarcinoma (LUAD), lung squamous cell carcinoma (LUSC), urothelial carcinoma, endometrial cancer, renal cancer, gliomas, ovarian cancer, colorectal cancer, neuroendocrine cancer, sarcomas and head and neck squamous cell carcinoma (HNSCC).
13. The method of embodiment 12, wherein the urothelial cancer is bladder cancer (BLCA), muscle invasive bladder cancer (MIBC), renal pelvis cancer, ureteral cancer, or urothelial carcinomas not otherwise specified (NOS).
14. The method of any one of the above embodiments, wherein the sample is a formalin-fixed, paraffin-embedded (FFPE) tissue sample, fresh or a frozen tissue sample, an exosome, or a bodily fluid obtained from the patient.
15. The method of embodiment 14, wherein the bodily fluid is blood or fractions thereof, urine, saliva, or sputum.
16. The method of any one of the above embodiments, wherein the determining the FGFR3 activation signature of the sample obtained from the patient suffering from cancer comprises determining expression levels of a plurality of classifier biomarkers selected from Table 1 or Table 2.
17. The method of embodiment 16, wherein the determining the expression levels of the plurality of classifier biomarkers is at a nucleic acid level by performing RNA sequencing, reverse transcriptase polymerase chain reaction (RT-PCR) or hybridization-based analyses.

18. The method of embodiment 17, wherein the RT-PCR is quantitative real time reverse transcriptase polymerase chain reaction (qRT-PCR).
19. The method of embodiment 18, wherein the RT-PCR is performed with primers specific to the classifier biomarkers selected from the plurality of classifier biomarkers of Table 1 or Table 2.
20. The method of embodiment 17, wherein the hybridization analysis is a microarray-based hybridization analysis.
21. The method of any one of embodiments 16-20, further comprising comparing the expression levels of the plurality of classifier biomarkers of Table 1 or Table 2 to an expression level of the plurality of classifier biomarkers of Table 1 or Table 2 in at least one sample training set, wherein the at least one sample training set is from a reference FGFR3 mutation-containing cancer sample, or is from a reference FGFR3 mutation-free cancer sample; and classifying the sample as having a positive FGFR3 activation signature based on the results of the comparing step.
22. The method of embodiment 21, wherein the comparing comprises applying a statistical algorithm that comprises determining a correlation between the expression levels of the plurality of classifier biomarkers of Table 1 or Table 2 obtained from the sample and the expression levels of the plurality of classifier biomarkers of Table 1 or Table 2 from the at least one training set; and classifying the sample as possessing a positive FGFR3 activation signature on the results of the statistical algorithm.
23. The method of embodiment 22, wherein the at least one training set is from a reference FGFR3 mutation-containing cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample.
24. The method of embodiment 22 or 23, wherein the at least one training set is from a reference FGFR3 mutation-containing cancer sample and from a reference FGFR3 mutation-free cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample.
25. The method of any one of embodiments 16-24, wherein the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes, at least 80 classifier genes, at least 90 classifier genes, at least 100 classifier genes, at least 110 classifier genes, at least 120 classifier genes or at least 130 classifier genes of Table 1.
26. The method of any one of embodiments 16-24, wherein the plurality of biomarker nucleic acids comprises, consists essentially of or consists of all the classifier biomarker nucleic acids of Table 1.
27. The method of any one of embodiments 16-24, wherein the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes or at least 80 classifier genes of Table 2.
28. The method of any one of embodiments 16-24, wherein the plurality of biomarker nucleic acids comprises, consists essentially of or consists of all the classifier biomarker nucleic acids of Table 2.
29. The method of any one of embodiments 1-15, wherein the determining the FGFR3 activation signature of the sample obtained from the patient comprises measuring an expression level of gene A and gene B for a plurality of biomarker gene pairs selected from Table 3 or Table 4.
30. The method of embodiment 29, further comprising determining a score for the sample by summing a classifier model intercept and coefficients from Table 3 or Table 4 for each gene pair from the plurality of biomarker gene pairs selected from Table 3 or Table 4 where the expression level of gene A is greater than the expression level of gene B, wherein the sample is deemed to have a positive FGFR3 activation signature if the score is calculated to be above zero.
31. The method of embodiment 29 or 30, wherein the measuring the expression levels of gene A and gene B for the plurality of biomarker gene pairs selected from Table 3 or Table 4 is at a nucleic acid level by performing RNA sequencing, reverse transcriptase polymerase chain reaction (RT-PCR) or hybridization based analyses.
32. The method of embodiment 31, wherein the RT-PCR is quantitative real time reverse transcriptase polymerase chain reaction (qRT-PCR).
33. The method of embodiment 32, wherein the RT-PCR is performed with primers specific to each gene in a gene pair from the plurality of biomarker gene pairs of Table 3 or Table 4.
34. The method of embodiment 31, wherein the hybridization analysis is a microarray-based hybridization analysis.
35. The method of any one of embodiments 29-34, wherein the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs, at least 80 biomarker gene pairs, at least 90 biomarker gene pairs, at least 100 classifier genes or at least 112 biomarker gene pairs of Table 3.
36. The method of any one of embodiments 29-34, wherein the plurality of biomarker gene pairs comprises, consists essentially of or consists of all the biomarker gene pairs of Table 3.
37. The method of any one of embodiments 29-34, wherein the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs or at least 73 biomarker gene pairs of Table 4.

38. The method of any one of embodiments 29-34, wherein the plurality of biomarker gene pairs comprises, consists essentially of or consists of all the biomarker gene pairs of Table 4.

39. A method of treating cancer in a patient, the method comprising: measuring the expression level of a plurality of classifier biomarkers in a sample obtained from a patient suffering from cancer, wherein the plurality of classifier biomarkers are selected from a set of biomarkers listed in Table 1 or Table 2, wherein the measured expression levels of the plurality of classifier biomarkers provide an FGFR3 activation signature for the sample; and administering an FGFR inhibitor based on presence of a positive FGFR3 activation signature, wherein the positive FGFR3 activation signature is indicative of presence of one or more FGFR3 mutations.

40. The method of embodiment 39, wherein the measuring the expression levels of the plurality of classifier biomarkers is at a nucleic acid level by performing RNA sequencing, reverse transcriptase polymerase chain reaction (RT-PCR) or hybridization-based analyses.

41. The method of embodiment 40, wherein the RT-PCR is quantitative real time reverse transcriptase polymerase chain reaction (qRT-PCR).

42. The method of embodiment 41, wherein the RT-PCR is performed with primers specific to the classifier biomarkers selected from the plurality of classifier biomarkers of Table 1 or Table 2.

43. The method of embodiment 40, wherein the hybridization analysis is a microarray-based hybridization analysis.

44. The method of any one of embodiments 39-43, further comprising comparing the expression levels of the plurality of classifier biomarkers of Table 1 or Table 2 to an expression level of the plurality of classifier biomarkers of Table 1 or Table 2 in at least one sample training set, wherein the at least one sample training set is from a reference FGFR3 mutation-containing cancer sample, or is from a reference FGFR3 mutation-free cancer sample; and classifying the tumor sample as having a positive FGFR3 activation signature based on the results of the comparing step.

45. The method of embodiment 44, wherein the comparing comprises applying a statistical algorithm that comprises determining a correlation between the expression levels of the plurality of classifier biomarkers of Table 1 or Table 2 obtained from the sample and the expression levels of the plurality of classifier biomarkers of Table 1 or Table 2 from the at least one training set; and classifying the tumor sample as possessing a positive FGFR3 activation signature on the results of the statistical algorithm.

46. The method of embodiment 45, wherein the at least one training set is from a reference FGFR3 mutation-containing cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample.

47. The method of embodiment 45 or 46, wherein the at least one training set is from a reference FGFR3 mutation-containing cancer sample and from a reference FGFR3 mutation-free cancer sample and the sample is classified as possessing the positive FGFR3 activation signature if the expression levels of the plurality of classifier biomarkers of Table 1 or Table 2 correlate with the expression levels of the plurality of classifier biomarkers of Table 1 or Table 2 from the reference FGFR3 mutation-containing cancer sample.

48. The method of any one of embodiments 39-47, wherein the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes, at least 80 classifier genes, at least 90 classifier genes, at least 100 classifier genes, at least 110 classifier genes, at least 120 classifier genes or at least 130 classifier genes of Table 1.

49. The method of any one of embodiments 39-47, wherein the plurality of biomarker nucleic acids comprises, consists essentially of or consists of all the classifier biomarker nucleic acids of Table 1.

50. The method of any one of embodiments 39-47, wherein the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes or at least 80 classifier genes of Table 2.

51. The method of any one of embodiments 39-47, wherein the plurality of biomarker nucleic acids comprises, consists essentially of or consists of all the classifier biomarker nucleic acids of Table 2.

52. A method of treating cancer in a patient, the method comprising: measuring an expression level of gene A and gene B for a plurality of biomarker gene pairs selected from Table 3 or Table 4 in a tumor sample obtained from a patient suffering from cancer, wherein the measured expression levels of gene A and gene B for the plurality of biomarker gene pairs selected from Table 3 or Table 4 provide an FGFR3 activation signature for the sample; and administering an FGFR inhibitor based on presence of a positive FGFR3 activation signature, wherein the positive FGFR3 activation signature is indicative of presence of one or more FGFR3 mutations.

53. The method of embodiment 52, further comprising determining a score for the sample by summing a classifier model intercept and coefficients from Table 3 or Table 4 for each gene pair from the plurality of biomarker gene pairs selected from Table 3 or Table 4 where the expression level of gene A is greater than the expression level of gene B, wherein the sample is deemed to have a positive FGFR3 activation signature if the score is calculated to be above zero.

54. The method of embodiment 52 or 53, wherein the measuring the expression levels of the plurality of classifier biomarkers is at a nucleic acid level by performing RNA sequencing, reverse transcriptase polymerase chain reaction (RT-PCR) or hybridization-based analyses.

55. The method of embodiment 54, wherein the RT-PCR is quantitative real time reverse transcriptase polymerase chain reaction (qRT-PCR).

56. The method of embodiment 55, wherein the RT-PCR is performed with primers specific to each gene in a gene pair from the plurality of biomarker gene pairs of Table 3 or Table 4.
57. The method of embodiment 54, wherein the hybridization analysis is a microarray-based hybridization analysis.
58. The method of any one of embodiments 52-57, wherein the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs, at least 80 biomarker gene pairs, at least 90 biomarker gene pairs, at least 100 classifier genes or at least 112 biomarker gene pairs of Table 3.
59. The method of any one of embodiments 52-57, wherein the plurality of biomarker gene pairs comprises, consists essentially of or consists of all the biomarker gene pairs of Table 3.
60. The method of any one of embodiments 52-57, wherein the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs or at least 73 biomarker gene pairs of Table 4.
61. The method of any one of embodiments 52-57, wherein the plurality of biomarker gene pairs comprises, consists essentially of or consists of all the biomarker gene pairs of Table 4.
62. The method of any one of embodiments 39-61, wherein the FGFR inhibitor shows inhibitory activity toward fibroblast growth factor receptor-3 (FGFR3).
63. The method of any one of embodiments 39-62, wherein the FGFR inhibitor is a tyrosine kinase inhibitor.
64. The method of embodiment 63, wherein the FGFR inhibitor is a selective tyrosine kinase inhibitor.
65. The method of embodiment 63, wherein the FGFR inhibitor is a non-selective tyrosine kinase inhibitor.
66. The method of any one of embodiments 39-65, wherein the FGFR inhibitor is selected from the group consisting of erdafitinib (JNJ 42756493), infigratinib (BGJ398), Rogaritinib (BAY 1163877), AZD4547, Pemigatinib (INCB54828), TAS-120, LY2874455, DEBIO 1347, PD173074, BLU9931, pazopanib, brivanib, ponatinib (AP24534), regorafenib (BAY 73-4506), lenvatinib (E7080), dovitinib (TKI258), lucitanib (E3810), nintedanib (BIBF 1120), Foretinib, and any combination thereof.
67. The method of any one of embodiments 39-66, wherein the FGFR inhibitor is nintedanib (BIBF 1120).
68. The method of any one of embodiments 39-62, wherein the FGFR inhibitor is an antibody or antibody-conjugate.
69. The method of embodiment 68, wherein the FGFR inhibitor is B-701 or MFGR1877S.
70. The method of embodiment 68, wherein the FGFR inhibitor is LY3076226.
71. The method of any one of embodiments 39-70, wherein the cancer the patient is suffering from is selected from the group consisting of breast cancer (BRCA), pancreatic adenocarcinoma (PAAD), lung adenocarcinoma (LUAD), lung squamous cell carcinoma (LUSC), urothelial carcinoma, endometrial cancer, renal cancer, gliomas, ovarian cancer, colorectal cancer, neuroendocrine cancer, sarcomas and head and neck squamous cell carcinoma (HNSCC).
72. The method of embodiment 71, wherein the urothelial cancer is bladder cancer (BLCA), muscle invasive bladder cancer (MIBC), renal pelvis cancer, ureteral cancer, or urothelial carcinomas not otherwise specified (NOS).
73. The method of any one of embodiments 39-72, wherein the sample is a formalin-fixed, paraffin-embedded (FFPE) tissue sample, fresh or a frozen tissue sample, an exosome, or a bodily fluid obtained from the patient.
74. The method of embodiment 73, wherein the bodily fluid is blood or fractions thereof, urine, saliva, or sputum.
75. A method of detecting a biomarker in a sample obtained from a patient suffering from cancer, the method comprising, consisting essentially of or consisting of measuring the expression level of a plurality of biomarker nucleic acids selected from Table 1 or Table 2 using an amplification, hybridization and/or sequencing assay.
76. The method of embodiment 75, wherein the sample was previously diagnosed as being a cancer selected from bladder cancer, breast cancer, pancreatic adenocarcinoma, lung adenocarcinoma, lung squamous cell carcinoma, and head and neck adenocarcinoma.
77. The method of embodiment 75 or 76, wherein the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques.
78. The method of embodiment 77, wherein the expression level is detected by performing qRT-PCR.
79. The method of embodiment 78, wherein the detection of the expression level comprises using at least one pair of oligonucleotide primers per each biomarker nucleic acid from the plurality of biomarker nucleic acids selected from Table 1 or Table 2.
80. The method of any one of embodiments 75-79, wherein the sample is a formalin-fixed, paraffin-embedded (FFPE) lung tissue sample, fresh or a frozen tissue sample, an exosome, wash fluids, cell pellets, or a bodily fluid obtained from the patient.
81. The method of embodiment 80, wherein the bodily fluid is blood or fractions thereof, urine, saliva, or sputum.
82. The method of any one of embodiments 75-81, wherein the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes, at least 80 classifier genes, at least 90 classifier genes, at least 100 classifier genes, at least 110 classifier genes, at least 120 classifier genes or at least 130 classifier genes of Table 1.

83. The method of any one of embodiments 75-81, wherein the plurality of biomarker nucleic acids comprises, consists essentially of or consists of all the classifier biomarker nucleic acids of Table 1.

84. The method of any one of embodiments 75-81, wherein the plurality of biomarker nucleic acids comprises, consists essentially of or consists of at least 10 classifier genes, at least 20 classifier genes, at least 30 classifier genes, at least 40 classifier genes, at least 50 classifier genes, at least 60 classifier genes, at least 70 classifier genes or at least 80 classifier genes of Table 2.

85. The method of any one of embodiments 75-81, wherein the plurality of biomarker nucleic acids comprises, consists essentially of or consists of all the classifier biomarker nucleic acids of Table 2.

86. A method of detecting a biomarker in a tumor sample obtained from a patient suffering from cancer, the method comprising, consisting essentially of or consisting of measuring an expression level of gene A and gene B for a plurality of biomarker gene pairs selected from Table 3 or Table 4 using an amplification, hybridization and/or sequencing assay.

87. The method of embodiment 86, wherein the tumor sample was previously diagnosed as being a cancer selected from bladder cancer, breast cancer, pancreatic adenocarcinoma, lung adenocarcinoma, lung squamous cell carcinoma, and head and neck adenocarcinoma.

88. The method of embodiment 86 or 87, wherein the amplification, hybridization and/or sequencing assay comprises performing quantitative real time reverse transcriptase polymerase chain reaction (qRT-PCR), RNAseq, microarrays, gene chips, nCounter Gene Expression Assay, Serial Analysis of Gene Expression (SAGE), Rapid Analysis of Gene Expression (RAGE), nuclease protection assays, Northern blotting, or any other equivalent gene expression detection techniques.

89. The method of embodiment 88, wherein the expression level is detected by performing qRT-PCR.

90. The method of embodiment 89, wherein the detection of the expression level comprises using at least one pair of oligonucleotide primers per each biomarker nucleic acid in each biomarker gene pair from the plurality of biomarker gene pairs selected from Table 3 or Table 4.

91. The method of any one of embodiments 86-90 wherein the sample is a formalin-fixed, paraffin-embedded (FFPE) lung tissue sample, fresh or a frozen tissue sample, an exosome, wash fluids, cell pellets, or a bodily fluid obtained from the patient.

92. The method of embodiment 91, wherein the bodily fluid is blood or fractions thereof, urine, saliva, or sputum.

93. The method of any one of embodiments 86-92, wherein the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs, at least 80 biomarker gene pairs, at least 90 biomarker gene pairs, at least 100 classifier genes or at least 112 biomarker gene pairs of Table 3.

94. The method of any one of embodiments 86-92, wherein the plurality of biomarker gene pairs comprises, consists essentially of or consists of all the biomarker gene pairs of Table 3.

95. The method of any one of embodiments 86-92, wherein the plurality of biomarker gene pairs comprises, consists essentially of or consists of at least 10 biomarker gene pairs, at least 20 biomarker gene pairs, at least 10 biomarker gene pairs, at least 10 biomarker gene pairs, at least 30 biomarker gene pairs, at least 40 biomarker gene pairs, at least 50 biomarker gene pairs, at least 60 biomarker gene pairs, at least 70 biomarker gene pairs or at least 73 biomarker gene pairs of Table 4.

96. The method of any one of embodiments 86-92, wherein the plurality of biomarker gene pairs comprises, consists essentially of or consists of all the biomarker gene pairs of Table 4.

It is understood that the disclosed invention is not limited to the particular methodology, protocols and materials described as these can vary. It is also understood that the terminology used herein is for the purposes of describing particular embodiments only and is not intended to limit the scope of the present invention which will be limited only by the appended claims.

All publications, patents and patent applications herein are incorporated by reference to the same extent as if each individual publication or patent application was specifically and individually indicated to be incorporated by reference. It is not an admission that any of the information provided herein is prior art or relevant to the presently claimed inventions, or that any publication specifically or implicitly referenced is prior art.

While the invention has been described in connection with specific embodiments thereof, the foregoing description has been given for clearness of understanding only and no unnecessary limitations should be understood therefrom. It will be understood that the description is capable of further modifications and this application is intended to cover any variations, uses, or adaptations of the invention following, in general, the principles of the invention and including such departures from the present disclosure as come within known or customary practice within the art to which the invention pertains and as may be applied to the essential features hereinbefore set forth and as follows in the scope of the appended claims. Those skilled in the art will recognize or be able to ascertain using no more than routine experimentation, many equivalents to the specific embodiments of the invention described herein. Such equivalents are intended to be encompassed by the following claims.

SEQUENCE LISTING (394 sequences)

SEQ ID NO: 1 - DNA, 8798 bp, Homo sapiens
agttactgccctgacggcggcggcggcggcggttggccggtgggggctggggcgagcacgaccgattctgctgggaaagctggaactggcagccgccgggggccaagaggaggatccggagctgggagcgtgccccgggcccggcggaggaggcggctgcagttggagtggagtcttgggagcgctgctggcagcgacttctcagcgaagcaagtgtctgagactgagagtccctaacagcggcagcggcggccacggcggcggctggggccgagttacttgtggaaattgttgattacccggacgtcttaaaaccaagaaacctgtgaacaggttcattaagaatctgctgtcttgaaaaatgcatattatgaatgctttgaattaagaaggtgttaacagtggttgtcatttctgccacataagagactataatctgaaacagttcctggcagttgcccagatgcctgaaactggcacgatctagtactcttgagtgatcatccttcaacgagaaatacagagctacttacatactgtacctcataccgtataaatgtaatctctctgatgccatttaatgcagtggacctcttttcagaatctaattgtcagatgcagaattaacacttggaatctggagaagcattttgtacaaattgaaagattgggttttttctttagttttccacatgtattgtctcatctctgttcttgaaacatccacaatcacataaactccagttataaccatggagttatgtgactcattaaaatttaggaaaagtgttgctgagctgtggaatcaggcgtttctccctcagttcaacaactaatacatagactgctgatcaagaataaggaaccaaataaagtcatgcacgttctgttgacagaggaactctgtggctgttgaattttactgtaactagttactctgtcttcagagtcaacttaatatacaagttatgtcataatggatggaaagacctgtgttgatgtatccagactctagcaaatgaagataaaaaacccgttatgactaatccttgggaagagaaagtctgcaaaatggctcaaaccagtttactgcaagggaagcagttttactgtagggagtgggttttccacaagcttcagcattgcctccaggagaaaagtaactgctgcaatagtgctgtcaatgcaccatcacttgtaatgaattctgggaataatgctagtggtgtctctggaaagggagctgcctggggtgtgttgttggtaggagggcctggcagtggcaagacggccctatgtactgaactcttatggccaagttcacctgcaagtttgcagagaggtttacatcgccaagctttggcctttcatttctgcaaagcccaggactctgatactttgtgtgttggagggtttattagaggtctagtagcccagatctgccgcagtggactactccaaggatatgaggacaagctaagggatccagcagtccaaagcctcttacagcctggggagtgcgagagaaacccagccgaagcatttaaaaggtgtgttctactccctcttctgggaatgaagcctccccagcaaagcctatacctgcttgttgattctgttgatgaagggtgtaacattactgaaggtgaacaaacgtctaccagcttatctgggactgttgcagcacttttagctggtcaccatgagttctttccaccatggctattgcttctctgttctgcccgaaagcagagtaaggctgttactaaaatgtttactggttttcgaaaaataagtttagatgaccttcggaaggcatatatcgtcaaggatgttcagcagtacattcttcatcgtttagatcaagaagaagctttgcgacaacacctcacaaaagaaactgcagagatgttaaatcaactgcacattaaaagcagtggatgctttctttacctagaacgagttttagatggagttgtagaaaattttattatgttaagagaaattcgtgacatcccaggaactctaaatggtttatatctctggctgtgccaaagactttttgtaagaaaacaatttgcaaaggttcagcctattttgaatgtgattcttgcagcctgccgacctttgaccataacggaattatatcacgcagtatggaccaaaaacatgtcgttaactttggaagattttcaacgcaagttagatatcctctccaaacttcttgttgatggactaggaaatacaaaaatactgtttcattatagttttgccgagtggcttctggatgtgaaacactgtactcagaagtatttatgtaatgcagcagaaggacacagaatgttggctatgagttatacctgtcaagccaagaatttaacaccattggaagcacaagaatttgcattgcacttaattaactcaaacttacaattagagacagcggagttagctctgtggatgatatggaatggtacacctgtcagagattccctttctactttgatacccaaggaacaagaagtgctacagctgttggttaaagctggggctcatgtcaacagtgaagacgatcgcacatcatgcatagttcgacaagccttagaaagagaggattccattcggacattattagataatggagcttcagtaaatcagtgtgattcaaatgggagaacattattggctaatgctgcatatagtggcagtcttgatgtagtcaatttacttgtctctaggggagcagatttagagatagaagatgctcatggacatacaccactcactctagcggctagacagggacataccaaggtggttaattgtttgattgggtgtggagcaaatattaatcatactgatcaagatggttggacagcattaagatctgctgcttggggtggccatactgaggtagtttctgcactactttatgctggcgtaaaagtggattgtgcagatgctgatagccgaacagctttgagagcagcagcatggggaggacacgaggatattgtactgaatttgctacaacatggcgctgaagtgaacaaagctgataatgaaggtagaactgctttgatagcagcagcatacatgggacatagagagattgtggaacacctactggaccatggagcagaagtaaatcatgaggatgttgatggcaggactgcactctctgtagctgcactttgtgtgcctgcaagtaaagggcacgcatcagttgttagccttttaattgatcgaggtgctgaagtagatcattgtgataaagatggcatgactccactgctggtagctgcctatgaaggacatgttgatgtggttgacttgcttctagaagggggagcagatgtagatcacacagataacaatggccgtacacccctcttagcagcagcgtctatgggtcatgcatcagttgtaaatacacttttgttttggggtgcagctgtggatagtattgatagtgaaggtaggacagtcctcagtatagcttcagcacaaggaaatgttgaggtggtacgtactctactggatagagggttagatgaaaatcacagagatgatgctggatggacacctttgcacatggcagcttttgaagggcacagattgatatgtgaagcacttattgaacaaggtgctagaacaaatgagattgacaatgatggacgaatccctttcatattagcttcacaagagggtcattatgattgtgttcaaatattactggaaaacaaatccaacattgatcaaagaggttatgatggaagaaatgcactgcgggttgctgcattagaagggcacagggacattgttgaattgctttttagccatggtgctgatgttaactgcaaagatgctgatggtcggcctacactttatatcttggccttagaaaatcagcttacaatggccgaatattttttagaaaatggtgcaaacgtagaagcaagtgatgctgaaggaaggacagcacttcatgtgtcttgttggcaaggccatatggaaatggtgcaggtcctgatagcataccatgctgacgtcaatgctgcagacaatgaaaagcgctctgctttgcagtctgcagcctggcagggccatgtaaaagtggttcagcttctgattgagcatggtgctgtagttgaccatacatgtaaccaaggtgcaactgcactctgtattgcagcccaggaagggcacattgatgttgttcaggtcttattagagcatggtgctgatccaaaccatgctgatcaatttggacgcactgctatgcgtgttgcagccaaaaatggacattctcagataattaaattattagaaaaatatggtgcatctagtttgaatggctgttccccatctcctgttcacacaatggagcaaaaacctctacagtcattgtcttcaaaagtgcagtcattaacaattaaatcaaatagctctggtagtactggtggaggggatatgcagccttcgttacgtggtttacctaatgggcctactcatgcttttagttctccttcagaatctccagattctacagttgaccggcagaagtcatcactgtcaaataattccctgaaaagctcaaaaaattcatctttgagaactacttcatctacagcaacggctcaaacagtgccaattgatagctttcataacttgtcatttacagaacaaattcagcagcattcattgccacgcagtagaagtcgacagtcaattgtttccccatcttccacaacacagtccttaggacagagtcataattcaccaagtagtgaatttgagtggagtcaagtaaagcccagtttgaagtcaactaaagcaagtaaaggggggaaatcagaaaattctgccaagtctggatcagctgggaaaaaagcgaaacaaagtaattcttcacagccaaaggttttagaatatgaaatgactcagtttgatagaagaggacctatagccaaatccgggactgctgcaccacctaaacaaatgccagcagaatctcaatgcaaaattatgataccttcagctcagcaggaaattggtcgatctcaacagcagtttcttattcaccaacaaagtggggaacagaagaagagaaatggaataatgacaaatccaaattatcatcttcagagcaaccaggtttttcttggtagggtttcagtcccacgaacaatgcaagatagagggcatcaggaagtgttggagggatacccttcctcagagacagaattaagccttaaacaagctctgaagcttcagattgaaggttctgaccctagcttcaactataaaaaggaaacaccattataaaagtttcctattctgtgaaacagaagacattgtgatggagtggttcttcagctactggatggaaacatatgcctgttgatttgctgaaaaaacaaaaaaaatgaagaatgtgatctctgcagtacagttaccttaattactgtaatgtgcctaaatagtaaggctgccttctcaatgtaaccctctgtgcttaaaaaatttcattttgtgtgctttgtattcactacacaggaataagcactttttaaaaatgcagatacatactgcagttccctgataaaagctgaaaagaaaatttgagtattttaagttaagatgtgataaaaaatgtgcatgtgccataatcaaatatatatgaaaaggcagtgttccttgtatttatttttttttctttttgtggcaaaagaaacttaaacatactgtttcagtcacattgcattgtagtgtatggcctgtttcttgtatctttaaagacgttgctcaataaaacaaatcttgcaactgttctatgttcactacaccttcagcattggataaaaatcattttctatataaatatcacattgaaatgaaaaaatgatttcttggcagtttaaaaaaaatattttatagtagtttagggagctgctttaagtagtttaaatctggattttcccagtagaattcttctcatctctggctaaacatgtcagaacaaacaaccaaccagtctgtaggcagaacaaagtcctatttcatccgctgggatacaatttcatcttccattcactttgtcattccacctctaagaagacagactatcattcctgaggcatgaaaattctcagggacaaagccatgcctcagtcacatgtgtgtgcagagagaaatgcacctgtctatctaagggtagatttttgatccctgaataattcattgactaaactgacctcttcctcctggctaaataaattaattttgctggcttctctctcagcggtttctattttgtaaattgctgcatgaccaaaatagccccactcaaaatcaattggattaattttaatggtttggttggatgaatattctggatgaatataaaatgtgctgcccttcacagatgacaccactcccctgtcaatcatagcacatgtgtactttttattgttacttaatagtgatggatttgcacttttctatcctcatactctttcctgttttcttctttgtacaattgcatgcaggagggctggatgccagggttaagagagaaattcatgacaaggaaggtaaaattggttcaaatgagcatgtgtcccacagccttagtctccttactcttaaatcagtggagctgtagcttagatgggtcgtttatatgtctggaaaagttgtcataacagtttagaagccaaggttgtggatttgatcttagaatgggcctgttaatcttatagaacccagaaattctgttcttttcatgtactgttgatgaggaatgaggaaagagaatttggagattcagcacaaaaccattgctacttctagaacaaaatctttagaatatgtcctaataacaaaggtcagtaatgtcatcttcatatatgaaggacacatgtgatacattgttcgtggaaatagaaatgtataattatgataaatgtttcacttgaatcttattgtaaggcttttcttgcttttattttttaaagtcagcaaaactcattttgtctgtcatctataagtcatagtgaggactacgagataagttgataagttcaattgatattaaggtgacatggcaatattaataactcaaatgtgaatgtttcaagtattgaattcttgtccctatgggacatttattaaataaaattaatgggactcttgcaaagtagccttaaaagtgttaatgagtctattaataaatatgaacacatactattattagaaccaactttactcatatctcaaatacagtacatttacattactgtagaggatgaagctctaatttctattacatgtaattttctttagaaagagaaccctgaaagctgccagtttttctattaactttgaattattgaaattgtatttatttaattttattgtttttacaaaattgcaccttgtgtccaaagggcgaagatatgacattgcataagggatttatgtttttcaaagagctaactgttttcatatccatactatatacacttgaagcaattggtaggaagagaacctattggaaaaatacgattttcaaaagtaagtattcctcgggatgtttttatataaattatgttttggaatagaacataaatgactttgagttaggataaggatgataggatgggtgctggagatgccctgccttgcttatttgtttctgtgggggatttaatactataaatgaaaatggcttctgctccattaaaaagtaaaaattgtcctccaaatataaaactccttaatagatatttttgaaattaaaatctttaaattttataaatcagctgttgccactacacaactatgatggcatgtgcttataacatttttataacattccgtctgtgtctattccctaaatatcatgagtttataataaggaaagtgataaaaatacagtaatgaaataaaaatctgaatgtttctaagaaaggttttggaaggaaaaatgacctgaaatcagtgcgtactgcaaagtacagccaataatttttgttctttgttttcacccccaccctcactggaattctcaccaaaaatagtttgatacttaaaaaacagaagtaaatacttttctcaatattgttttggctatgcaaatatttgttttgcttaatgtcctccatttacacttctcagcaaatgtagttgcaaacaaatgctttctttttatttttcccttggtttgaggtatgtaaatagccaaaaatgtacattgaatttcacattgtaaaagttttattttatcccttgtatgatattactcaaaaaatccctgtgtatatgaaagtgcataataaatatatttgctttacagagaagatcttgttttaattttgtccttgaaccagtagaacatgcatgatatgcatatagcataaacaactgttagttgttttaagttattatcttaaataaatcctgagcaaatgaatttggaaacattttgcaaagaagaaagtgaaatataacactgtccaaaggaaggtagaaaaacaaagatttactgtttatgtcttcctaagcctttttaaagacttaatgttcttttcccccccgtgactgattatatactatatcacaccatgtcaggttttgtgcctctgagaattgcagtaatccaataacttttgtatatgtgtgctccttgatcatcagaatattatggccatcttatggcggatattttgggagtttattgcaaacatggtcattcattttctaaataaaatttgtgtgtttcttcactcagtaaa

SEQ ID NO: 2 - DNA, 1441 bp, Homo sapiens
atccagatttgcttttacattttcttgcctgagtctgaggtgaacagtgaacatatttacatttgatttaacagtgaaccttaattctttctggcttcacagtgaaacaagtttatgcaatcgatcaaatattttcatccctgaggttaacaattaccatcaaaatgttttgtggagactatgtgcaaggaaccatcttcccagctcccaatttcaatcccataatggatgcccaaatgctaggaggagcactccaaggatttgactgtgacaaagacatgctgatcaacattctgactcagcgctgcaatgcacaaaggatgatgattgcagaggcataccagagcatgtatggccgggacctgattggggatatgagggagcagctttcggatcacttcaaagatgtgatggctggcctcatgtacccaccaccactgtatgatgctcatgagctctggcatgccatgaagggagtaggcactgatgagaattgcctcattgaaatactagcttcaagaacaaatggagaaattttccagatgcgagaagcctactgcttgcaatacagcaataacctccaagaggacatttattcagagacctcaggacacttcagagatactctcatgaacttggtccaggggaccagagaggaaggatatacagaccctgcgatggctgctcaggatgcaatggtcctatgggaagcctgtcagcagaagacgggggagcacaaaaccatgctgcaaatgatcctgtgcaacaagagctaccagcagctgcggctggttttccaggaatttcaaaatatttctgggcaagatatggtagatgccattaatgaatgttatgatggatactttcaggagctgctggttgcaattgttctctgtgttcgagacaaaccagcctattttgcttatagattatatagtgcaattcatgactttggtttccataataaaactgtaatcaggattctcattgccagaagtgaaatagacctgctgaccataaggaaacgatacaaagagcgatatggaaaatccctatttcatgatatcagaaattttgcttcagggcattataagaaagcactgcttgccatctgtgctggtgatgctgaggactactaaaatgaagaggacttggagtactgtgcactcctctttctagacacttccaaatagagattttctcacaaatttgtactgttcatggcactattaacaaaactatacaatcatattttctcttctatctttgaaattattctaagccaaagaaaactatgaatgaaagtatatgatactgaatttgcctactatcctgaatttgcctactatctaatcagcaattaaataaattgtgcatgatggaataatagaaaaattgcattggaatagattttatttaaatgtgaaccatcaacaaccta

SEQ ID NO: 3 - DNA, 12895 bp, Homo sapiens
ggaagtggaggtgagctgtcgcgggcggcgcccggccttgctcaacgcccagcagtccccaccgtcgctgccgccgccaccgccctcggccgctgccgaggcctcctgcagccatcatgtccgccagcgccgtctacgtgctggacctgaagggcaaggtgctcatctgccggaactaccgtggcgacgtggacatgtcagaggtggagcacttcatgcccatcctgatggagaaggaggaggaggggatgctgtcgcccatcctggcccacgggggggtccgtttcatgtggatcaaacacaacaacctgtatctggttgccacatccaagaagaacgcgtgcgtgtcgctggtcttttctttcctctataaggtggtgcaggtgttttccgagtacttcaaggagctggaggaggagagcatccgggacaactttgttatcatctacgagctgctggacgagctcatggacttcggctacccccagaccaccgacagcaagatcctgcaggagtacatcactcaggaaggccacaagctggaaacaggggccccgcggccaccagccaccgtcaccaacgcggtgtcctggcggtccgaaggcatcaagtatcggaagaatgaggtgttcttggacgtcatcgagtctgtcaacctcttgggtaaatacccaggagtgggatggctgggtcacacggtcagcgccaacggcaatgtcctgcgcagcgagatcgtgggctccatcaagatgcgagtcttcctctcgggcatgcccgagctgcgcctgggcctcaacgacaaggtcctctttgacaacacgggccgcggcaaaagcaaatccgtggagctggaggatgtgaagttccaccagtgtgtgcggctatcacgcttcgagaatgaccgcaccatctccttcatcccacccgacggcgagttcgagctcatgtcctaccgtctcaacacccacgtcaagcctttgatatggatcgagtcggtgatcgagaagcactcccacagccgcatcgagtacatgatcaaggccaaaagccagttcaagcggcggtcaacagccaacaacgtggagatccacattcccgtgcccaatgatgccgactcacccaagttcaagacgacggtggggagcgttaagtgggtccccgagaacagcgagatcgtgtggtccatcaagtccttcccgggcggcaaggagtacctgatgcgggcccacttcggcctgcctagtgtggaggccgaagacaaggagggcaagcccccgatcagtgtcaagttcgagatcccttacttcactacctccggcatccaggtgcgctacctgaagatcattgagaagagtgggtaccaggccctgccctgggtgcgttatatcacgcagaatggagattaccagctccggacccagtgaggggctgtcgcagccaacaccccggcctcggggctcctggtggcagcaccaggggacacacctgccaaacccaccagatggaggggccctccctggtctctggccaccctcccagcctctgcccagggacccctgccttccccaggccatctgctctgccgtcgacactcgtctcagaagcccctttcccagaagaggctggtcttcaagaagtctcgtttctttgcccctgaagtcagtttcaggggaaggatgtgaaatttttccgtgtagaggttacagccttttatgctgttgagctcccaggtaccaaaaagcttggccaacgcttgccagccagccagctgcaggtggcatctgccacgaaggaagcgccagcctcgccaggccagcaggggcgtcgttttgttgccattttgttgaacgttatgggtttatgggtgttcctggaacttgtctttgtgcattcgttgctgtttgtgttaccctcactgtccccatgtcccacccacgtcctacggcactcaggaagcacttggtgaggacgagccctcacccttcttgtcttccttcccggcagcgcccgcagcgggccatttacacgtcgaggctggcacctggcgcgctcgggggccactgtagcgtctgcctgctccctggactcgcaggcctcgcctgtggcgccttcccagggccagcctgggtcacgagatgctgtcactcagccagatcagtattgacccaccaggggaggtggggtttggtgagagacgccagcctcagactttttcccactgagggtccagagagcggggccacgtgtcacccacgtctgcgcttggtcacccgtcctccccaccctgtgtgtgtttatgtcatagttacattaaattccattcattgaatactccacagccttcctctgatgcagcgtggtcccaactcctcctgcgtgaccacagggcttgcctggttttgtcgccgaccttccctgtggccccacgaggtgtcaccagctccctctgcttccccagctgaaacacaggaaaagcagctgcgggaagaggcagctgcagtgctggaccatgggccaccactcctgggccacacagaggaggccacagaggcagagtcttctctcatccaatctgctgcaccctcagatggccaacagcttgtccccacctctccccaaactgatggcccactcagagcatggtccttgtgtccacagcagcatcccctgtgtcctagctagaaatgcaggttcgtgggccagccctgacctgccaaagtggaggctctggggccagggtcccggaaaacattaacaaggcccccagatgcttcttctgtgaactgctacttggtccatgggggaaatagcacatatgcaggaagtgctgcctgctcttggccccctccccgaccagtgctgatggccctgcctggccagcaccctcttgccttcattctccccctccctctcctgtcttgccgagctcgtcctcaggtgtctagtgggcatccgacctaacagcctgagtagaaccttccgcccacgtaggtcttccccatctcagtcaatgacgctgccccagcccaggcctcagaccaaagccctgaaggcatccctggggcccctcccctcactgtccacacccatatcagcagccagccctcatggcccctccagaaaaccctggggctgaccccatttgccatcctcgctgccacccccggggcctagctccagtgtgggctgtcactgtccccaccctgtggagcccccatgctgggacaccgcagggacaggagagggctggtccacaggacagaagagagacttcagtttccagcaacttatcagataagacctgcaaaccctccactacagactgtagaaatgcaggaaatgaagcagacgcacctagccgtgcccataaaaaagcaaggagacccacaggagcccaagacgaaggaagtagacgcggaagacaccgtgggggctcacaccggagttgctcttggaaaccaccgggtttaggtttgggggccaggtggcagataggactttgggcatcgggaagatggtgaaatgcagtggagatgactcctgcgtgaagctgggatcctcgagggtcatgatacttaacagtaaaaagatggactagaaaaaacatttgccctccacccctgagaataagcactgtgtcctctctctgcctgagatccacaggagaaaaagtcaccactcatttagaccccacgcttgtaatatcaatctggtttgcagacaaccaggccaagatgtttatgacagaaaacctccctggagggacctaacttcatgccttgttacctaagatcctcgcacacaatagaccctcaacatgagggcacatcctgaaaattacaaaacacgtgcatgaaagcaaacttgaaacagcaggatcagatcctcacgaacttcaaagattatcggcatgtaaacaaatacactatgcagtcaatctgttgcaagtgcctaaaggcacagagactctgaatagaaaagagcaaaatgctgttaagacagagctgttacaacatccaacaaggcaaataatttgcatgcgggttataacgtctacaaatcagaaaaagagaacctaacaaaatgggctgtgtgtgaacagacagtatgaagaagatgaaatacaaatggcgaccgttcggccaggcgtggtggctcacgcccgtgagcccaatactttgggaagccgaggcagaccgatcactggaggtcaggagttcgagaccagcatggccagcatggtgaagccccatctatactaaaaatacaagaattagccgggtgtggtggtgcgtgcctgtaatcccagctactcagtatgctgaggcaggagaatggcttgaacccaggaggtggaggttgcagtgagccaagatagtgttactgcactccagcctgggcaacagagcgagactccgtctcaaaacacaacaaaaaccggcctagcgcagtggcttatgcctgtaatcccagcactttgggaggctgagacgggtggatcacctgaggtcaggagtccgagaccaacctggccaacatggcgagaccccatctctactaaaaataccaaaattagccaggcatggtggcgggcgcctgtaatcccagctacttgggaggctgaggcatcagaatcatttgaaccccaggaggcagaggttgcagtgagccgagatcataccacctgcactccagcctgggcaacagagcaagacttcatctcaaaagaaaaaaaaaaggcaaacgttcaaccatgtagctattcaggaaatatgtacacataaaccaagaccacagttagatgctatttgcatcatgtcggccccccccaaaaaaatttttttttttgagacagggtcttgctatgttacccaggctggagtgcagtggcgtgatcacggctcactgcagcctcgagctgccaggctcagccaatcctgcctcagcctcttgaggagctgggactacaagcacatgccaccatgctgggccaatttttcatattttttatagagatggggtctcgtcattttgtccacactggtctccaactcctgggcttgagccatcatcctgccttggcctcccaaagtgctgggattacaggcgtgagccacctcgccacgcctcctgaacatctagaacgtgctagctatgtactgactgtgggaaagttgagaacatcctccctgaagtcatctttatgccagaattctcttgcagaactctagttgagaaaagccctgagaagtccatgcaccaatatatagagaaatatcaggtgtacagttacacttacagcagcatagttcatgatagcaggaaattggaaagcaaccaaaagtccttcaataggaaaagggaccactgtagtccattcatgcaagagattacagcagtgaaaatgaattcaactagagcagtgatatggctcagaatacaacttaaacaacattgagcgggaaaaatgtttacaaaagaaaatgcagtaatctagtataaaatacggaaataatattttgcgtgcttagggatctatatatatccagcaaaagtctaacgagatgcttgagaatttgaaaaaattcacatccctggttatctctgaaaggcaaaaacaggaagggggtatgactggggcctctgctgtgttggcaatttccttaagcttggtattgcttagtggcttgttctgtattctttctttatgctttttttttttttttttgacagggtgtcactctgttgcccaggccaaagtgcagtggcatggtcacggctcactgcagcttcaaactcctgggctcaagtgatcctcccaccttggcctcccaaagtgctgggattacaggcatgagccacagtgcccagccctttttgtagttcttaatatactttttgtagtttttttgttttttgtttttgtttttgttttttttgagacagagttttgctcttgttgcccaggctggagtgcaatggtgtgatctcggctcactgcaacctccgccttctgggttcaagcaattctcctgcctcatcctcctgagtagctgagattacaggcatgcgccaccatgcctggctaattttgtatttttggtagagacgggatttctccatgttggtcaggctggtctcgaactcccggcttcaggtgatccgcccccctcaccttcccaaagtgctgggattacaggcatgagccaccgcgcccggccagttctcttttttttttttttttttttttttttttttttttttttttaagactgcaaagctgggcatggtagtatgcacctgtagtcccaactacttgggaggctgaggctagaggattacttgagcccaggagtttaaggacagcctgggcaacatagtgagaccctgtctctaaaacaaaccaacaaaacaccccccaaaaatgacaatgcagatttggaagaaaaaaatagattaaaaatgtagtcataggaattaacaacttggggccgggcatggtggctcacgcctataatcccagcactttgggaggctgaggcggccagatcattttaggtcaggagtttgagaccagcctggccaacatggtaaaacctgattgctactaaaaatacaaaagaattagctgggcgtagtggctcatacctgtaatcccagctactcaggtggctggggcaggagattcgcttgaacccgggagatggcgctcgcagtgagtcaagatggcaccgttgtactcttgcctgagcgacacagtgagacactgtctcaaaaaaaaaaattaacaacttggttggagggtgttaaaatacaagtgagacatagatgaagagaattagtgcactagaagagagctgtctgaggcagttacccgggacatagcacagctaatgagacatatatatatttacagtcaaccctccacatccatgggttctgcatccatggattcaaccaagagtgagttgaaaatatttgaaaaacaattgtgtctgtgctggacatgtacaggttttcttttttattgtcattattccttaaataatacagtataatgattatgtagcatctacattgtattaggtaatctagagatgatttaaagatgatgtgcataggatatatgcaaatattgtgccattttatataaaagacttgagcatcctcagattttggtatccaaggggagtcctggaagcaatcccttgaggatatggagggacgactctgtgtgtgtgtgtgtgtgtgtgtgtgtgtgtatgtgtgtgtgtgtgtgtgtgtgtgtgtgatgtgcgtgtgtggttagcacaagacaataagaaggcccaacatgccagcaagtatctaacacaaaccaaaaaatgagaactggggagcagccacatgcaaagagatcgtggccagaattttccaaaattaatgaaaatcttgaagtgttttttgtttttcattttgacggagtttcgcgtttgttgcccaggctggagtgcaatggcgaaatctcggctcattacaacctctgcctcccaggttcaagcaattctcatatctcagcctcccaagcagctgggattacaggtgcacaccaccacgcccggctaatttttgtattttttgtagagatggggtttcactatgttggtcaagatggtctcgaactcctgacctcaggtgatctgcctgcttcggcctcccaaagtgctgggattacaggcatgagccactgcgcccagcctgaaaatcttgaaattttaagatccaggaaaccgttgagtccaaagcatgatacacaaacctaaattcgtaactaaaataatcatagtcgaaccacagaacatatcagactcagggaagatcctaacagcaacactaagagattaaaatgtctctccaaagagcaattggacagagaactggtttcacaactggaacaacaaaagtccgaagatagagcatggcttcaaattactgagagaagtgcagtctagaattctgagcccacctcatctgtaaaaggtaggacaagccgggcatggtggctcccgcctgtaatcccagcactctgggaggccgaggcgggcagaggtcaggagtttgagaccagccggaccaacaaggagaaaccccatctctactagaaatacaaaattagccaggtgtggtggcgggcacctgtgttcccagctacttgggagactgaggcagacagaattgcttgaaccagggagacagaggttgcagtgagccgagatcgcgccactgtactccagcttgggcaaagtgagattctgtctcaaaaaaaaaaaaagacaagataaaaacaatttatcaataacagattccccgaaaaaaggaacttgtgtacataaggaaaggaagaaagatgtgagaaggaatgccggaaaaccttagaaaccattggatctgtctaaactgtcattgactgtgtaaagcaataataacagtgactaacgtatagagtagcgacaaaaggcgcaactgaagtactagacaacatcctggtgttcatgcctttcaaggtcactatgctatttgggaggagattcggctaaagtccacgagggccacgtatttatatataatttctagaccagtggttggaaaagggttgaaagaaaacttttaacagattaataggaagaaggaaaagagaaggaggcgtagaaaaatcaggaggcactgggcgcggtggctcacgcctgtaatcccagcactttgggaggctgaggcaggcggatcacctgaggttgggagttcgagatcagcctgactaacatgagaaaccccgtctctactaaaaatataaaattagccgggtgtggtggtgcatgcctataatcccagctactcgggagggtgaggcaggagaatcgcttgaacctgggaggcagaggttgtggtgagctgagatcgcgccattgcactccagcctgggcaatgagcgaaactccatctcaaaaaaaaaaagaaagaaaaagaaaaagaacaatcaggaggccaggttcagtggctcatgcctgtaatcccagtgctttgggaggctgaggctgagacaggtgaattgcttgagcctaggagtttgagaccagcctgggcaacatggagaaactctgtctctacaaaaattagccaggcatggtggcgcacacctgtagtccaaactactcaggaggctgagttgggaggatcacctgagttcaggaagctgaggctgcagtgagctgtgattgcaccactgcactccaggttgggtgacagagtgacaccctgcctcaaaaaaaaaaaataaaataaaggaaaaatcaggataaatgcagggatgttctaaactttttaaaataataaataatagtacttaaaactgcactgggacttttgggacacccctagcatctctggctgcagaaagcataaaataagattgtagaaataaatccagatattaggaaccacaacaggtgtaaatgaagcaaagctgctagttgaagatgttgtcggattgaactgaaatacaaaatcctgtgatatcctgtttatacgcgatacatctaaaatgtaagtacacaacacaattgaaagtaaaaaaacattaaaagatgtgacacttaaaatataagcacacaacacagttaaaagtaaaaagacattaaaagatgccaaaagaaatctcatatggttatattaattccagacagaatagatgtatttatttatttattcattcatttaattttttgagatggagtctcgctctgtcgcccaggctggagtgcagtggcgcgatctttgcttactgcaacctccgcctcccgggttcaagtgattctcctgcctcagtctcctcagtagctgggattacaggcatgcaccaccatgcttggctaaatttttttatttttgtattttttttatttttagtagagacagggttttgccatgttggccaggctggtcttgaaccctgacctcaggtgatccacccccactggcctcccaaagtgctagtggcaggtgtgagccaccacacacggccagaatagactttaaagcaagaaagcaaaagaaaaaatgtattagatccccgagaagtttccacacaactccaagaattattattagagttcccactctctgaggaattttcaagagaaattagttagaattcaacaagaaataaattactttaaaatatttccaaatatgagaggttttttttgtttttgtttttgtttttgtttttgtttttgttttgagaaagggtctctgttgcccaggctggagtgcagtcagtggcacgatgtcagctcactgcaaccttggcctcctaggctgaaatagtcctcccatctcagtctcacaagtagctgggattacaggtgagcaccaccaagctcagctattttttttttttttttgtatttttagtagagatggagttttgccatgttgcccaggctggtcttgcacttgggctcaagtgatccacctgcctcagcctccacagtgctggaattacaggtgtgagtcaccatgcccagccaatatgagagattttaaagcacatttttcaatcaccatgtgtcaaagaagaaaatataatggaagttagaaaatattagagaatggccaggtgcagtggctcatgtctataatcccagcactttaggaggctgaagcaggtgaatcacttgagctcaggagttcgagaccagcctggccaacatggcgaaaatccatctctactaaaaatacaaaaattaaccaggtgtagtggcacacgcctgtaaatcccagctactcaggaggctgaggcccaagaatggcttgaaccctggaggcagaggttgcagtgagctgagattgtgccactgcactccagcctgggcaacgaaacgagagtctgtctccaaataaataattagagaatatttttcaatctggatgcaggtgacatgggtgtgctctcgagaatccatcaagcattgatgatttgcacactcttttgtgtatatgttacacttcagcaaaaacattcacaaaggggaaaaaggcaaaagatacttaaagcagccagaggtaaagacacatcaccttcagacatgacaaccagacagacagacagctggcttttcaaaggaacccagaaaacagttgggtgacattttcaacatgctaaaagaaaaccactaacccaaatcagagacccagcaaaagtatttcaagaatgaggttacagtaaaaacattttgcagacaaataacgaaagagtttgccagcagcaggctaacactaaagaaaattgtaaacagtgtactcacatcaggcacaaggaaagtgatctcagacggaagggcatgatgcaagaagaaataaaagcaaagaagtagaaaatacatgagaaaatctagacaaagattgcataaacagtttctggagtttttttaagtgatagaattatacaacaggaaaaaaagtctgcagggagtaaactgagttaaaatgttccaagttaatgactgtctgggaggagaataaataacatggatacactttgggaggccgaggcgggcggatcacgaggtcaggagatcgagaccatcctggctaacacggtgaaaccccgtctctactaaaaatacaaaaaattagccgggcgcggtggcgggcgcctgtagtcccagctactccggaggctgaggcaggagaatggcgtgaacccgggaagcggagcttgcagtgagccgagattgcgccactgcagtccgcagtccggcctgggcgacagagcgagactccgtctcaaaataaataaataaataaataaataacatggataaaatttgttgtttgttgttgttgttgttgttgttgttgttgttgagacggagtttcgctcttgttgcccaggctggagtgcaatggcgcggtctttgctcactgcaacctctgcatcccgggttcaagctattctcctgcctcagcctcctgagtagctgggattacacgatgcgccaccaggcctgcctaactttgtatttttggtagaggcggggtttctccatgttggtcaggctggtctcaaactcccgacctcaggtgatccgcccgcctcggcctcccaaagtgctgggattacaggcatgagccactgcgcccagccaaatctgcattttgataagtatgcattttactatctaagggagctaaaacatttttattattttagcactgtaactttgcttttcttctttgttttgtttttttgagacagagtctcactctgtcgcccaggctggagtgcagtggcgtgatctcagctcactgcaacctccacctcctgggttcaagcaattctcctgcctcagcctcctgagtagccaggattacaggtgcacgccaccacacccagctaatttatgtaattttatagagttgtggtttcaccatattggccaagctggtctagaactcctggcctcaagtgatccacctgcctcggcctcccaaagtgcggggagaccagaattccacccagaatgacctctctgttcctaggagtgtgacagcatttgggggggaaaatagcgtagagttggaatttttaaaattcagtttgacaaaatgacttttagctggagcattaagtccctttacatttaatgtaataactgatattacatttaagtataaatttaaatctaccgtcttactttgttttctatttttgtcctttctatgttctcttttatgtcctctctggatttattacagattgtttgtggcttttaaaaaaagtcattgcttgaatgatgagagcttatatttaaaaaggcagggggctaaaataaataaataatttaaaaaataaaaa

SEQ ID NO: 4 - DNA, 5258 bp, Homo sapiens
acccagaacctcggacgagcggcgggcacccgcgagcggacggcggccgcgtagtgagcaatggcctgagcccccatggctgcccctcaggacctggacatcgctgtgtggctggccacggtgcacctggagcagtatgcagacacgttccgacggcatggcctggctacagcaggtgcagcccggggcctgggccacgaggagttgaagcagttgggcatcagcgccacagggcaccggaaacgcattctacgcctgctacagacaggcaccgaagagggctccctggatcccaaatcagatagtgccatggaaccatcccccagcccagccccgcaagcccagccccctaagcccgtgccgaagcccaggaccgtgtttggtggactcagtggccctgccaccactcagagacctgggctgagcccagccctcgggggaccaggagtgtccaggagcccagagcccagcccaaggcctcctcctctccccacttcctcctctgagcagtcttcagccctaaatactgtggagatgatgcctaattccatctacttcggcctggactcaagaggcagggcacaggcagctcaggacaaggccccagacagctcccaaatctctgcccccacccctgccctcaggcccacaacaggcacagtgcacatcatggatcctggttgcctgtactatggtgtccaacctgtggggactccaggagcccccgacagaagagagagcagaggtgtttgtcagggcagggctgaacacaggctcagcagacaggatctggaggcacgggaggatgctggctatgccagccttgagctacctggagactccaccctcttatcgcccaccctggaaacagaggagaccagtgatgacctcatttcaccctatgccagcttctccttcacggcagaccgcctcacgcccctgctcagtggctggctagacaagctctcccctcagggaaactatgtcttccagagacgctttgtgcagttcaatgggaggagtctgatgtactttggcagtgacaaggaccccttccctaagggtgtgatacctttgactgccattgagatgacccgcagcagcaaggacaacaagttccaggtcatcaccggccagagggtgttcgtgttccgcacagagagcgaggctcagcgggacatgtggtgctccacgctgcagtcctgtctgaaggagcagcgcctcctgggccacccccggcccccccaaccaccccgacccctccgcacgggcatgctggagctgcgtggacacaaggccaaggtgtttgctgccttgagccctggagagctggcactgtacaagagtgagcaggccttctctctgggcatcgggatctgcttcatcgaactgcagggctgcagcgtccgggagaccaagagtcgaagctttgacctgctcacaccccatcgctgcttcagcttcacagccgagtctgggggtgctcggcagagctgggcggccgctctgcaggaagcagtaaccgagaccctgtctgactacgaggtggctgagaagatctggtctaatcgggccaaccggcagtgtgcggactgtgggtcctcccgcccagattgggctgctgtcaatttgggggtggtcatctgcaagcagtgtgcaggtcagcaccgggccctgggttctgggatctccaaggtgcagagcctgaagctggacacgagtgtctggagtaatgagatagtacagttattcattgtcctgggaaatgatcgtgccaaccgcttctgggcagggaccctacccccaggtgagggactacatccagatgcgacccctggcccccggggagagttcatctcccgaaagtaccgtctgggtctcttccggaagccccaccctcagtacccagatcatagccagcttctccaggcactgtgtgcagctgtggcaagacccaacctgctgaagaacatgacccagctcctctgtgttgaggcctttgaaggcgaggagccctggttccccccagcccctgatggcagctgccctggcctcttgccctcagacccctcccctggtgtgtacaatgaggtggtggtgcgtgctacttacagcggcttcctgtactgcagtcccgtcagcaacaaagctggaccctcaccccctcgcaggggccgggatgctcccccgcgcctttggtgtgtgctgggagcagctctggaaatgtttgcatcggaaaacagccctgaacccctcagcctcatacagccccaggatattgtatgtctgggtgtgagccccccacccactgacccaggtgacaggttccccttttcctttgagctcatcctcgctggggggaggatccagcattttggcacagatggagctgacagtctggaggcctggactagtgctgtgggcaagtggttctccccgctgagctgccaccagctgctgggccccgggctgctgcggctgggccgcctatggctgcggtccccctcccatacagccccggcccctggtctctggctgtcagggtttggcctccttcgtggtgaccacctcttcctgtgctcagcgccgggcccaggccccccagcccctgaggacatggtgcatctgcggcggctacaggagatcagtgtggtttctgcagctgacaccccagataagaaagagcatttggtcctggtggagacaggaaggaccctgtatctgcaaggagagggccggctggacttcacggcatggaacgcagccattgggggcgcggctggtgggggcggcacagggctgcaggagcagcagatgagccggggtgacatccccatcatcgtggatgcctgcatcagttttgttacccagcatgggctccggctggaaggtgtataccggaaagggggcgctcgtgcccgcagcctgagactcctggctgagttccgtcgggatgcccggtcggtgaagctccgaccaggggagcactttgtggaggatgtcactgacacactcaaacgcttctttcgtgagctcgatgaccctgtgacctctgcacggttgctgcctcgctggagggaggctgctgagctgccccagaagaatcagcgcctggagaaatataaagatgtgattggctgcctgccgcgggtcaaccgccgcacactggccaccctcattgggcatctctatcgggtgcagaaatgtgcggctctaaaccagatgtgcacgcggaacttggctctgctgtttgcacccagcgtgttccagacggatgggcgaggggagcacgaggtgcgagtgctgcaagagctcattgatggctacatctctgtctttgatatcgattctgaccaggtagctcagattgacttggaggtcagtcttatcaccacctggaaggacgtgcagctgtctcaggctggagacctcatcatggaagtttatatagagcagcagctcccagacaactgtgtcaccctgaaggtgtccccaaccctgactgctgaggagctgactaaccaggtactggagatgcgggggacagcagctgggatggacttgtgggtgacttttgagattcgcgagcatggggagctggagcggccactgcatcccaaggaaaaggtcttagagcaggctttacaatggtgccagctcccagagccctgctcagcttccctgctcttgaaaaaagtccccctggcccaagctggctgcctcttcacaggtatccgacgtgagagcccacgggtggggctgttgcggtgtcgtgaggagccacctcgcttgctgggaagccgcttccaggagaggttctttctgctgcgtggccgctgcctgctgctgctcaaggagaagaaaagctctaaaccagaacgggagtggcctttggaaggtgccaaggtctacctgggaatccgcaagaagttaaagcccccaacaccgtggggcttcacattgatactagagaagatgcacctctacttgtcctgcactgacgaggatgaaatgtgggattggaccaccagcatccttaaagcccagcacgatgaccagcagccagtggtcttacgacgccattcctcctctgaccttgcccgtcagaagtttggcactatgcctttgctgcctatccgtggggatgacagtggagccaccctcctctctgccaatcagaccctgcggcgactacacaaccggaggaccctgtccatgttctttccaatgaagtcatcccaggggtctgtggaggagcaagaggagctggaggagcctgtgtacgaggagccagtgtatgaggaagtaggggccttccctgagttgatccaggacacttctacctccttctccaccacacgggagtggacagtgaagccagagaaccccctcaccagccagaagtcattggatcaaccctttctctccaagtcaagcacccttggccaggaggagaggccacctgagccccctccaggccccccttcaaagagcagtccccaggcacgggggtccctagaggaacagctgctccaggagctcagcagcctcatcctgaggaaaggagagaccactgcaggcctgggaagtccttcccagccatccagcccccaatcccccagccccactggccttccaacacagacacctggcttccccacccaacccccatgcacttccagtccaccctccagccagcccctcacatgaccctaggaccagcagtctgagagggtaggtaccagaagacccagaaactcttatcgtggcactgttgcagcttcctctgccctggctggaaagactccagaatccagtgtggtgctgtggaaggagcactggactaaaggcttcagtggctgcgtgtcccaggacaggtcatggcccctctctgggcccagcccatttatctataccatgaggtaactgaagtaaggagagcagtgaatgtcaaactgtgtttcttagagccataagccccacatattatccctgaacaagggcagctcctgctttatatatttgatacgtaggggttccatgagagattttgggttttaaaggaatggttttactgcattaaagaaaaaaaatgctttggaaaccagaggcctgggtgatgttaaagtctatcctgtcccacttcctacattctgggactaccgtgaagcctggagtagggagagcgagtttgggagctgggactcggggagtcaaaaatagatgagtaattgtcaataaacctgggaaccaaaaga

SEQ ID NO: 5 - DNA, 4625 bp, Homo sapiens
gcgtcgcgcacggcggcggcggcgggaccaggcctcggagcgcggcgggcgcgggcgcagtcccggcgggcccggacctcgcgggcgggcgggcggcgcggccattggctcgggtggcggcggctgcggcggtgggggcgccgtcccggccatgggcgcccgcggcggcctgcggagctggaggcgcggcgccggccgccaggcgcctttgtgagcggcgcggacgacaaaggcgcgggcccgggcagccgaggtgtgtagctgggacggtgctggtctgagctggaccttgtctgatggcttcctccaaccctcctccacagcctgccataggagatcagctggttccaggagtcccaggcccctcctctgaggcagaggacgacccaggagaggcgtttgagtttgatgacagtgatgatgaagaggacaccagcgcagccctgggcgtccccagccttgctcctgagagggacacagaccccccactgatccacttggactccatccctgtcactgacccagacccagcagctgctccacccggcacaggggtgccagcctgggtgagcaatggggatgcagcggacgcagccttctccggggcccggcactccagctggaagcggaagagttcccgtcgcattgaccggttcactttccccgccctggaagaggatgtgatttatgacgacgtcccctgcgagagcccagatgcgcatcagcccggggcagagaggaacctgctctacgaggatgcgcaccgggctggggcccctcggcaggcggaggacctaggctggagctccagtgagttcgagagctacagcgaggactcgggggaggaggccaagccggaggtcgaggtcgagcccgccaagcaccgagtgtccttccagcccaagctttctccagacctgactaggctaaaggagagatacgccaggactaagagagacatcttggctttgagagttggggggagagacatgcaggagctgaagcacaagtacgattgtaagatgacccagctcatgaaggccgccaagagcgggaccaaggatgggctggagaagacacggatggccgtgatgcgcaaagtctccttcctgcacaggaaggacgtcctcggtgactcggaggaggaggacatggggctcctggaggtcagcgtttcggacatcaagcccccagccccagagctgggccccatgccagagggcctgagccctcagcaggtggtccggaggcatatcctgggctccatcgtgcagagcgaaggcagctacgtggagtctctgaagcggatactccaggactaccgcaaccccctgatggagatggagcccaaggcgctgagcgcccgcaagtgccaggtggtgttcttccgcgtgaaggagatcctgcactgccactccatgttccagatcgccctgtcctcccgcgtggctgagtgggattccaccgagaagatcggggacctcttcgtggcctcgttttccaagtccatggtgctagatgtgtacagtgactacgtgaacaacttcaccagtgccatgtccatcatcaagaaggcctgcctcaccaagcctgccttcctcgagttcctcaagcgacggcaggtgtgcagcccagaccgtgtcaccctctacgggctgatggtcaagcccatccagaggttcccacagttcatactcctgcttcaggacatgctgaagaacacccccaggggccatccggacaggctgtcgctgcagctggccctcacagagctggagacgctggctgagaagctgaacgagcagaagcggctggctgaccaggtggctgagatccagcagctgaccaagagcgtcagtgaccgcagcagcctcaacaagctgttgacctcaggccagcggcagctgctcctgtgtgagacgttgacggagaccgtgtacggtgaccgcgggcagctaattaagtccaaggagcgtcgggtcttcctgctcaacgacatgcttgtctgtgccaacatcaacttcaagcctgccaaccacaggggccagctggagatcagcagcctggtgcccctggggcccaagtatgtggtgaagtggaacacggcgctgccccaggtgcaggtggtggaggtgggccaggacggtggcacctatgacaaggacaatgtgctcatccagcactcaggcgccaagaaggcctctgcctcagggcaggctcagaataaggtgtacctcggccccccacgcctcttccaggagctgcaggacctgcagaaggacctggccgtggtggagcagatcacgcttctcatcagcacgctgcacggcacctaccagaacctgaacatgactgtggctcaagactggtgcctggccctgcagaggctgatgcgggtgaaggaggaagagatccactcggccaacaagtgccgtctcaggctcctgcttcctgggaaacccgacaagtccggccgccccattagcttcatggtggttttcatcacccccaaccccctgagcaagatttcctgggtcaacaggttacatttggccaaaatcggactccgggaggagaaccagccaggctggctatgcccggatgaggacaagaagagcaaagccccattctggtgcccgatcctggcctgctgcatccctgccttctcctcccgggcactcagcctgcagcttggggccctggtccacagtcctgtcaactgtcccctgctgggtttctcagcagtcagcacctcccttccacagggctacctctgggtcgggggcggacaggaaggcgcagggggccaggtggaaatcttttccttgaaccggccctcgccccgcaccgtcaagtccttcccactggcagcccctgtgctctgcatggagtatatcccggagctggaggaggaggcggagagcagagacgagagcccgacagttgctgacccctcggccacggtgcatccaaccatctgcctcgggctccaggatggcagcatcctcctctacagcagtgtggacactggcacccagtgcctggtgagctgcaggagcccaggtctgcagcctgtgctctgcctgcgacacagccccttccacctgctcgctggcctgcaggatgggacccttgctgcttaccctcggaccagcggaggtgtcctgtgggacctggagagccctcccgtgtgcctgactgtggggcccgggcctgtccgcaccctgttgagcctggaggatgccgtgtgggccagctgtgggccccgggtcactgtcctggaagccaccaccctgcagcctcagcaaagcttcgaggcgcaccaggacgaggcagtgagcgtgacacacatggtgaaggcgggcagcggcgtctggatggccttctcctccggcacctccatccgcctcttccacactgagaccctggagcatctgcaagagatcaacatcgccaccaggaccaccttcctcctgccaggccagaagcacttgtgtgtcaccagcctcctgatctgccagggtctgctctgggtgggcactgaccagggtgtcatcgtcctgctgcccgtgcctcggctggaaggcatccccaagatcacagggaaaggcatggtctcactcaacgggcactgtgggcctgtggccttcctggctgtggctaccagcatcctggcccctgacatcctgcggagtgaccaggaggaggctgaggggccccgggctgaggaggacaagccagacgggcaggcacacgagcccatgcccgatagccacgtgggccgagagctgacccgcaagaagggcatcctcttgcagtaccgcctgcgctccaccgcacacctcccgggcccgctgctctccatgcgggagccggcgcctgctgatggcgcagctttggagcacagcgaggaggacggctccatttacgagatggccgacgaccccgacatctgggtgcgcagccggccctgcgcccgcgacgcccaccgcaaggagatttgctctgtggccatcatctccggcgggcagggctaccgcaactttggcagcgctctgggcagcagtgggaggcaggccccgtgtggggagacggacagcaccctcctcatctggcaggtgcccttgatgctatagcgcctcccctctcccctcagagggcacagctgcaggcctgaccaaggccacgcccggctctcgtgctctaggacctgcacgggacttgtggatgggcctggactctccagaaactacttgggcagagcaaaggaaaacctcttgttttaaaaaaatttttttcagagtgttttggggaggagttttagggcttggggagagggaggacacatctggaggaaatggccttctttttaaaagcaaaaaacacaaaacctcacaactgcctggcaagcccagtatcacttgtttgggccctagcgggactccaaggcagccacacgcccctcctggaagggtgtgtgcgtgtgagtgtgtgcgagtgtgtgggctggtgtgtgaatatctataaataagtatatatggtgtatattatatgtgtataaataaagtctgtacatattggagctctgggagatgctggaataaaagacaagagttacatctgga

SEQ ID NO: 6 - DNA, 3295 bp, Homo sapiens
gtggtctgcgcgcgcccggccgtgcgtgcggatgcggggaggctgcgtgtgtgcgcagggagagaacgccggccaccttcccgcttccgagctgggtgcgcgccgagcacaggagattgcctgcgtttaggaggtggctgcgttgtgggaaaagctatcaaggaagaaattgccaaaccatgtctttttttctgttttcagagtagttcacaacagatctgagtgttttaattaagcatggaatacagaaaacaacaaaaaacttaagctttaatttcatctggaattccacagttttcttagctccctggacccggttgacctgttggctcttcccgctggctgctctatcacgtggtgctctccgactactcaccccgagtgtaaagaaccttcggctcgcgtgcttctgagctgctgtggatggcctcggctctctggactgtccttccgagtaggatgtcactgagatccctcaaatggagcctcctgctgctgtcactcctgagtttctttgtgatgtggtacctcagccttccccactacaatgtgatagaacgcgtgaactggatgtacttctatgagtatgagccgatttacagacaagactttcacttcacacttcgagagcattcaaactgctctcatcaaaatccatttctggtcattctggtgacctcccacccttcagatgtgaaagccaggcaggccattagagttacttggggtgaaaaaaagtcttggtggggatatgaggttcttacatttttcttattaggccaagaggctgaaaaggaagacaaaatgttggcattgtccttagaggatgaacaccttctttatggtgacataatccgacaagattttttagacacatataataacctgaccttgaaaaccattatggcattcaggtgggtaactgagttttgccccaatgccaagtacgtaatgaagacagacactgatgttttcatcaatactggcaatttagtgaagtatcttttaaacctaaaccactcagagaagtttttcacaggttatcctctaattgataattattcctatagaggattttaccaaaaaacccatatttcttaccaggagtatcctttcaaggtgttccctccatactgcagtgggttgggttatataatgtccagagatttggtgccaaggatctatgaaatgatgggtcacgtaaaacccatcaagtttgaagatgtttatgtcgggatctgtttgaatttattaaaagtgaacattcatattccagaagacacaaatcttttctttctatatagaatccatttggatgtctgtcaactgagacgtgtgattgcagcccatggcttttcttccaaggagatcatcactttttggcaggtcatgctaaggaacaccacatgccattattaacttcacattctacaaaaagcctagaaggacaggatactttgtggaaagtgttaaataaagtaggtactgtggaaaattcatggggaggtcagtgtgctggcttacactgaactgaaactcatgaaaaacccagactggagactggagggttacacttgtgatttattagtcaggcccttcaaagatgatatgtggaggaattaaatataaaggaattggaggtttttgctaaagaaattaataggaccaaacaatttggacatgtcattctgtagactagaatttcttaaaagggtgttactgagttataagctcactaggctgtaaaaacaaaacaatgtagagttttatttattgaacaatgtagtcacttgaaggttttgtgtatatcttatgtggattaccaatttaaaaatatatgtagttctgtgtcaaaaaacttcttcactgaagttatactgaacaaaattttacctgtttttggtcatttataaagtacttcaagatgttgcagtatttcacagttattattatttaaaattacttcaactttgtgtttttaaatgttttgacgatttcaatacaagataaaaaggatagtgaatcattctttacatgcaaacattttccagttacttaactgatcagtttattattgatacatcactccattaatgtaaagtcataggtcattattgcatatcagtaatctcttggactttgttaaatattttactgtggtaatatagagaagaattaaagcaagaaaatctgaagtattgtcttgtttttaaaaaatacagttcctagtgtttttagaagtcacttaatttgtctcatttttccacctggaaattaggaataatgtagaatgcaaggcagtaatttccttttggaaaggactctgaaggcagaaaagaagggagagaacctcatgggcagaatattataaaaagagtgtcatattccagcatttgaattggaaagagaagagtgaagatccaagttgcattattaatctgccctgtgttttttccttttaacaatcagtttgagctgctgctgttatgagtttctcatcaagatgaaagccctaatatgtaaagtcaaatccgatttaaattttgtgcttttatagaaagaaatttcttcatagacgtggtgatatatcatttgttggacctgctaatagtaggtcaaaggggagcactccttgccccctgttcctgggtttatgcagttttctttttagagtttatatagggcaagtggttctttttctctgaattacaggatggaaaaaggtcatatcctttgtcaggaaatataaacttgaaagtatgtagtcagctcttgtaatactcatatttatgattgtcctatatgaaaaacaacttcagttaaaactataatgtgtgattctgtataacaaggtgatgtctgtttcccagggctcagacctaatccagttataataaaatcaattaaatgaaatattctatagaatcgatctatgcccttgttaatctccatccatataggagtcacgttctttaagacagatggtggtagttatttttgtggcatggttagatttgactggttttgcagaagattacagttatgtactgcataatgacatatacaatagtggtcccataaaattataatggagcagaaaatctattgcctcatgatgttttagccgttttaatgtcatagcctagtgcattactcacgtgtctgtggagatgctggtgtaaacaaacctactacactgccagttgtataaaagtacagcacattcagttatgtacagtatgtaatactgataatgacaataaatgacaccggtttgtgtatttactttttataa

SEQ ID NO: 7 - DNA, 1007 bp, Homo sapiens
agcaacaaccacggaaaccaagacgagcgcggtcgcggaagtatcgcggcttacatatctcgcagccaggcgggtcctgggagaggcgcgagccaggcctggtcggcgcccgcggagaaaagaagcagtcaagcccatgaactacaaccccggttgccgctttctcctctcctaaccgttaagtgcgctaagggccatggctgaggtgcacgtgatcgggcagatcataggggccagcggtttctcggaaagtagcctcttctgcaagtggggcattcacacaggggcggcatggaagctcctgtcaggcgtgcgggagggccaaacgcaagtggacaccccgcagataggggacatggcttactggtcccaccccatcgacctgcacttcgccaccaaaggtcttcaaggctggccccggctccatttccaggtgtggtcccaggacagctttggccgctgccagcttgcaggctatggattttgccatgtgcccagtagcccgggcacccaccagctggcctgccccacgtggcggcccctgggcagttggcgagaacagttggcacgggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacgtcaccaccatccacaccccggacacccagtgatgggggaggatggcacagtggtcaagagcacagactctagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttacagg

SEQ ID NO: 8 - DNA, 1870 bp, Homo sapiens
acaaccacccaggaaaccaaggcaagctccccctgtcaaagcaccttggcccataagaagaaaagggggagccccagatgtgatgagcgcttccaggcttcaggctcagaaggcgcccccagctctcctgtaactcagaggccagtgtgatgggagttcctccactcagcacacttcccctgtaaacacgcctgtggtgggcaaaagggctttggaacggttgcttgtcttttctctcctgcgtaatttccactttcattcatgataatgtcgaacacgcagcacaaagctcggctggaacgccgggtcactggctcaaccaaccggtggcgtttgcccaaacagcctttctctggggacctgctctcactttcccagatgtgcaaggctctgagcatagactttgaggaagctttgaggaacccagacaggttatgcatttcacaaatccagaagtttttctttgagaatttcaagaacaaggacatccaaagtggggaagcagatgtgattctcgagtgcctgggcttcaaatgggagctccatcagccccagctttttcagtctgagaccttggccaagctctacctgaaagccctggcgcagggcaccacacaccccctgagggagctggaggagcttctgcgagctcaatcacctaagaagaccaaagaaaaatcccctgcaaagaggatcatcatttccttgaagatcaatgacccactggtcactaaagtcgccttcgccacggccctgaagaacctctacatgagtgaggtggagattaacttggaagacctactgggagtgctggcttccgcccacatcctccagttcagtggcctgtttcaaaggtgcgtggatgtgatgatagccagactcaagccaagcaccatcaagaaattctacgaggccggctgcaagtacaaggaagagcagctcaccaccggctgcgagaagtggctggaaatgaacttggttcctctaggggggacgcagatccacctccacaaaatcccacaggacctgctccacaaagtgctgaagtcccccaggttatttacctttagtgaattccatcttctgaaaacaatgcttttgtgggtcttcttgcaactgaactacaagattcaggcaattccgacttatgaaaccgtgatgacattttttaagagctttcctgagaactgttgctttctggaccgggacataggacggagcttgaggccgctcttcctctgcttgcgtctgcacggcatcaccaaaggcaaggatctggaggtgctgcggcaccttaacttcttcccagagtcatggctcgaccaggttacagtcaaccattaccacgcactggagaatgggggcgacatggtccacctgaaagatcttaacacccaggctgtgagatttgggctgctctttaaccaggagaatacaacttattcgaaaacgattgctctatatggattcttctttaagataaagggactcaaacatgatactacctcttatagtttttacatgcagagaataaagcacacagacctggaatctccctctgcggtctacgagcacaaccacgtcagcctgcgagcggcacgcctggtgaagtatgagatcagagcagaggccctggttgacggcaagtggcaggagttcaggacaaaccagatcaagcagaagtttgggttgaccacgtcatcctgcaaaagccataccttgaaaatccaaactgtgggcatcccaatctatgtaagttttgcattcatcttcccagcatcttgacagtttccagaagaatctatgggattttccccccactggtctgcataaaagaaaataaaatgacataaaagggagcactcaagca

SEQ ID NO: 9 - DNA, 1262 bp, Homo sapiens
tgtgtcacttccggcctccctttagctgccatcttgcgtccccgcgtgtgtgcgcctaatctcaggtggtccacccgagaccccttgagcaccaaccctagtcccccgcgcggccccttattcgctccgacaaggtacaaaaaggctctggacggcggcgtggtaggaggacgggagcgggggcgggaagttccctgaaggagcgagacagggagggacagggcagaggaggagaggaaggcgatgcgacggacaggcgcacccgctcaggctgactctcgggggcgaggtcgagccaggggcggctgccctgggggcgaggcgacgctgtctcaacctccacctcgcggcggaacccgaggacaggagcctcagatgaaagaaacaatcatgaaccaggaaaaactcgccaaactgcaggcacaagtgcgcattggtgggaaaggaactgctcgcagaaagaagaaggtggttcatagaacagccacagcagatgacaaaaaacttcagttctccttaaagaagttaggggtaaacaatatctctggtattgaagaggtgaatatgtttacaaaccaaggaacagtgatccactttaacaaccctaaagttcaggcatctctggcagcgaacactttcaccattacaggccatgctgagacaaagcagctgacagaaatgctacccagcatcttaaaccagcttggtgcggatagtctgactagtttaaggagactggccgaagctctgcccaaacaatctgtggatggaaaagcaccacttgctactggagaggatgatgatgatgaagttccagatcttgtggagaattttgatgaggcttccaagaatgaggcaaactgaattgagtcaacttctgaagataaaacctgaagaagttactgggagctgctattttatattatgactgctttttaagaaatttttgtttatggatctgataaaatctagatctctaatatttttaagcccaagccccttggacactgcagctcttttcagtttttgcttatacacaattcattctttgcagctaattaagccgaagaagcctgggaatcaagtttgaaacaaagattaataaagttctttgcctagtatacagttttatttttttatttcattgacaccgatctgtacacagtaaaaaaaattgcttatagaaagctaatcatggcatgtaatatggctgataacctttggaatttgattaaagatttaaaatcacaaaaaaaaaaaaa

SEQ ID NO: 10 - DNA, 2111 bp, Homo sapiens
ctccctgcagcccgcaacgggaatggagtaaagggagacccgtcgacctggccacggggatcagcgatggaattaaagcaatctttgtccacccatctggaagccgagaagcctctgaggcgctatggggcggtggaggagacggcttggaaaacggagagactggggagaaatcagctggacatcatctccatggcggagacaaccatgatgccagaggagattgagctggagatggcaaaaattcagcgtctccgggaagtcttggtccgccgggagtctgagctcaggttcatgatggatgacatccagctctgcaaggacatcatggacttgaagcaggagctgcagaacttggtcgccatcccagaaaaagaaaaaaccaaactgcagaagcagagagaggatgagctaatccagaagatccacaaactggtgcagaagagagacttcctggtggacgatgcggaggtcgagcggttaagggagcaagaagaagacaaggaaatggctgatttcctgagaatcaagttaaaacctctagacaaagtaaccaaatctccagccagctcccgggcagagaagaaagcagagcccccacctagcaagcccacggtggccaagacggggctggcactgatcaaggattgttgcggggccacccagtgcaacatcatgtagcccccacgtggggtgccctgggccatggggacccccccccaccctcttgtctttatagcccccatttcaccggggcccaagagctctccaaggcagaaggggttgaaggcaagcccgtgactgtcaccagaggccatgggcacggcaggcgggcctggccaccctgtacagagtgtagcagtagggagtctctcaccgtcgcatggtcctccccagagcatgccgaacccaggagtctgtctcactgtttatccaaacaccaggaaaggtcctccctcaaaaaagcatatctccacttctctctagctgtatctaacccaccgtgtgaatgaactgggagaggggcatgctccccagctgtgtgtagtcgtgacttctcaacaatctagcaccatgtcggacacgttccccatccaccctcctagctctgctctcagagctaggcacatgggcacaggtcccctcccgtctgtcctctcccagcaactgtgccctggagggctccacatggcccccgtgtctctcgggcaccacccatatagcagtcccagagggcccatctgtaaagatcgagcttgtgtgtggtgtcgtggtcacatctcccgcttccccccatcctgtgtctgggcacagttcacatcaggacagcgtccattgtgctctcagtctgcctcaggtgtgtgcctggagggggcctggactggcatggatccagtgtgcagaagagccagcagggaaccggaagctctgatgtcaaggccagagcagttgagaatgggacccagagtagatgctgacctgggcactccaccattccggggccaccacagagatgccagcaggatgccactttgccagcccgacacacggacctttgtaaagaacagcaacaggcaggagaggcagcgtgtgaccagattgtgtcccgtcattgggtggcatatgttaactagctgccaaacaacttcaacccgtgtaattcatgtacatttgcaacagccagcccggtacagcctgtgtgacttctctgtatgtgtgtgtgtgtcgtgaccagcctaagtagttagcataactcaagatgctgatgtgcagtcacccatcagagaaaataaaaatggaaaccacgttcacagcattttaaaagtttttactttttttcttgattatggaagtaatccatgtacatagtaaatcattttaaaagtacaaaaagtatgaagaagtttgtcttaaaaaaaaaaaaaattattcctccaactagagaccactctgatgtttcgacgttttaaaaaagtctttttttgtgcattttttcatcgttgacatcatattgtggtatcatttataaccagttttttcctacttattataccaccatcttccacatcattaaaagctctttgtaaacattaaacactcttcataaatca

SEQ ID NO: 11 - DNA, 600 bp, Homo sapiens
ctcccaaggccggcggcggcatggcggccaggcagatctgggcacggacgggtgccgcgctctgcaggcaaccttccgccgccccgccgccagcacctctctgggtaagagctgggttccgacagcagctcagcttaaccctctgccctgctaacgagggaaactgcggcggctccgcgcccagcacgcccggtaggccggagagagcggcgaggccttcggtgagcgaagagttaaccgcggcggagcgacagatcgcggagctgcacgctgccgcctgcgcggctggccagctaaactatgtggatccagctactggctatgtggtgctcacacagattgcccacttgcaaagaggtgaatgttgtggctctgcgtgcagacattgtccatatggtcaagtcaatgttaaagatccatctaaaaagaagcaattcaattcatatttttatgtttgacaagaatttcatctctgttccctaactgtgcttgtattttttaaaaaataaagccccaattcagaattgctggattattagtacttgaacactagtttaatcctaaatacatatattaaaagaacatcaataaaatgaaaaa

SEQ ID NO: 12 - DNA, 1546 bp, Homo sapiens
accgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggggatgaccagagtcattggcgctatggaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtgtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgagatccacgtggttcacctcagcaccgcctttgccagagttgacgaggccttggggcgcccgggaggcctggccgtgttggccgcctttctggaggagggcccggaagaaaacagtgcctatgagcagttgctgtctcgcttggaagaaatcgctgaggaaggctcagagactcaggtcccaggactggacatatctgcactcctgccctctgacttcagccgctacttccaatatgaggggtctctgactacaccgccctgtgcccagggtgtcatctggactgtgtttaaccagacagtgatgctgagtgctaagcagctccacaccctctctgacaccctgtggggacctggtgactctcggctacagctgaacttccgagcgacgcagcctttgaatgggcgagtgattgaggcctccttccctgctggagtggacagcagtcctcgggctgctgagccagtccagctgaattcctgcctggctgctggtgacatcctagccctggtttttggcctcctttttgctgtcaccagcgtcgcgttccttgtgcagatgagaaggcagcacagaaggggaaccaaagggggtgtgagctaccgcccagcagaggtagccgagactggagcctagaggctggatcttggagaatgtgagaagccagccagaggcatctgagggggagccggtaactgtcctgtcctgctcattatgccacttccttttaactgccaagaaattttttaaaataaatatttataataaaa

SEQ ID NO: 13 - DNA, 2580 bp, Homo sapiens
agtctgcattgagcttggctcaggaaagaagggaaatccaggcggggcctgttgggcccaggtcttgagctcttttggctccagagttcccagcacagtcatggatcaaaactcagtgcctgaaaaggctcagaatgaggcagacaccaataacgcagataggttctttcgctctcactcatcacccccacaccacaggccaggccacagcagagctctccaccattacgagttgcaccatcacggcgtgccccaccaacgtggtgaatctcaccaccctccggagttccaagacttccacgaccaagccttgtcctcccatgtccaccaatctcaccaccacagcgaggcacggaatcacggcagagcccatggccccacaggctttggtctggctccctctcaaggcgccgtcccctcccaccgttcctacggtgaggactaccatgatgagctccaacgtgatggcaggaggcatcatgatgggtcccaatacggtgggttccatcagcagagtgactcccattaccatagggggtctcaccatggcagaccccaatatctcggtgagaatttatcccactattcctctggcgtgccccaccacggtgaggcttcccaccatggtgggtcctacctcccccatggacccaatccctacagtgagtccttccaccacagcgaggcttcccaccttagcgggctccaacacgatgagtcccagcatcaccaagtcccccaccgtggctggccccaccatcaccaagtccaccaccatggcaggtcccgtcatcatgaagcccaccagcatggaaagtctcctcatcacggagagaccatttcccctcattcctctgtggggtcctaccagcgtgggatatctgactatcacagcgagtaccaccaaggtgatcaccaccccagtgagtaccaccatggcgaccatccccaccacacacagcaccactaccaccagacccaccggcaccgagactaccatcagcaccaagaccaccacggcgcgtatcattccagttacctccatggcgactacgtccagagcacttcccaactctctatcccacacacatcccggagcctgattcacgatgcccccggccctgctgcttctcgtacaggagtcttcccctatcacgtagcacacccacggggctcggctcacagcatgactcggtcctccagcacaatccgctcacgtgtcacccagatgtccaaaaaagtccatacccaggatatctccaccaaacattcagaagactggggcaaagaagaagggcaatttcagaaacgcaaaaccggccggctccagcggacccgcaagaagggacactctaccaatctcttccagtggctgtgggaaaagctaaccttcctcattcagggcttccgggaaatgatccggaacctgacccaatccttggcctttgaaactttcatcttcttcgttgtctgcctcaacaccgtcatgctggtggcccagaccttcgctgaagtcgagatccggggcgagtggtacttcatggccttggactccatattcttctgcatctacgtggtggaagccctgctcaagatcatcgccctgggcctctcgtacttctttgacttctggaacaatttggacttcttcattatggccatggccgtgctggacttcttgctgatgcagacccactccttcgccatctaccaccaaagcctcttccggatcctcaaggtcttcaagagcctgcgggccctgagggcaatccgggtcctgcggaggctcagcttcctgaccagcgtccaggaagtgacagggaccctgggccagtccttgccgtccatcgcagccatcctcatcctcatgtttacctgcctcttcctcttctccgcggtcctccgggcactgttccgcaaatctgaccccaagcgcttccagaacatcttcaccaccatcttcaccctcttcaccttgctcacgctggatgactggtccctcatctacatggacagccgtgcccagggcgcctggtacatcattcccatcctcgtaatttacatcatcatccagtacttcatcttcctcaacctggtgattactgtcctggtggatagcttccagacggcgctgttcaaaggccttgagaaagcgaagcaggagagggccgcccggatccaagagaagctgctggaagactcactgacggagctcagagctgcagagcccaaagaggtggcgagtgaaggcaccatgctgaagcggctcatcgagaaaaagtttgggaccatgactgagaagcagcaggagctcctgttccattacctgcagctggtggcaagcgtggagcaggagcagcagaagttccgctcccaggcagccgtcatcgatgagattgtggacaccacatttgaggctggagaagaggacttcaggaattgaccccaggaggacaccagatacagacttcagcccctggcagtctgcccacctgggtgcactgggacgggtccccagatctgctggaatgattgtccgggccctgcagagcaggggccccaacagagtttttaaacccc

SEQ ID NO: 14 - DNA, 1705 bp, Homo sapiens
gcagacagcctagctggactttgggtgaggcggttcagccatgaggctggctgtgcttttctcgggggccctgctggggctactggcagcccaggggacagggaatgactgtcctcacaaaaaatcagctactttgctgccatccttcacggtgacacccacggttacagagagcactggaacaaccagccacaggactaccaagagccacaaaaccaccactcacaggacaaccaccacaggcaccaccagccacggacccacgactgccactcacaaccccaccaccaccagccatggaaacgtcacagttcatccaacaagcaatagcactgccaccagccagggaccctcaactgccactcacagtcctgccaccactagtcatggaaatgccacggttcatccaacaagcaacagcactgccaccagcccaggattcaccagttctgcccacccagaaccacctccaccctctccgagtcctagcccaacctccaaggagaccattggagactacacgtggaccaatggttcccagccctgtgtccacctccaagcccagattcagattcgagtcatgtacacaacccagggtggaggagaggcctggggcatctctgtactgaaccccaacaaaaccaaggtccagggaagctgtgagggtgcccatccccacctgcttctctcattcccctatggacacctcagctttggattcatgcaggacctccagcagaaggttgtctacctgagctacatggcggtggagtacaatgtgtccttcccccacgcagcacagtggacattctcggctcagaatgcatcccttcgagatctccaagcacccctggggcagagcttcagttgcagcaactcgagcatcattctttcaccagctgtccacctcgacctgctctccctgaggctccaggctgctcagctgccccacacaggggtctttgggcaaagtttctcctgccccagtgaccggtccatcttgctgcctctcatcatcggcctgatccttcttggcctcctcgccctggtgcttattgctttctgcatcatccggagacgcccatccgcctaccaggccctctgagcatttgcttcaaaccccagggcactgagggggttggggtgtggtgggggggtacccttatttcctcgacacgcaactggctcaaagacaatgttattttccttccctttcttgaagaacaaaaagaaagccgggcatgacggctcatgcctgtaatcccagcactttgggaggctgaggcaggtggatcactggaggtcaggagtttgagaccagcctggccaacatggtgaaaccctgtctctactaaaaatacaattagccaggtgtggcggcgtaatcccagctggcctgtaatcccagctacttgggaggctgaggcagaactgcttgaacccaggaggtggaggttgcagtgagccgtcatcgcgccactaagccaagatcgcgccactgcactccagcctgggcgacagagccagactgtctcaaataaataaatatgagataatgcagtcgggagaagggagggagagaattttattaaatgtgacgaactgccccccccccccccccagcaggagagcagcaaaatttatgcaaatctttgacggggttttccttgtcctgccaggattaaaagccatgagtttcttgtca

SEQ ID NO: 15 - DNA, 2279 bp, Homo sapiens
gccattgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataaggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 16 - DNA, 2414 bp, Homo sapiens
agatactactccaggcacgggcattaggggctcccacaggctggacaggccttggactttcctggttgaaccgtgaggccgcggtgtcagtccacactccactgtgggtggcgggttcggccccgcgaggaggcgccgctctcaaaccccacggtcccgcgcagcgaagaggcgaggcggccgcggaaggcaggcgcagcccactcttcccgagaggccccgacatctcccggataatctggagctttcaaaatgtttgccaaagcaaccaggaattttcttagagaagttgatgctgatggtgacctgattgcagtatcaaatctgaatgactctgataagttacagcttctaagtctggtgacaaaaaagaagagattctggtgctggcagagacccaagtaccagtttttatccctcacccttggcgatgtactcatagaagaccaatttccgagtccagtggtcgtggagtcggactttgtgaaatacgagggcaagtttgcaaaccacgtgagtggaaccctggagactgcactggggaaggtcaagctgaacctggggggcagcagccgcgtagagagccagtcttcatttggaaccctgaggaagcaggaggtggatttgcagcagctcatcagagactctgccgagagaacaataaatctgagaaaccctgtgctccagcaggtgctggaaggaaggaatgaggtcctgtgcgttttgacacagaagatcacgacgatgcagaagtgtgtgatctctgagcacatgcaggtcgaggagaagtgtggtggcatcgtgggcatccagaccaagacggtgcaggtgtcagcgacggaggatgggaatgtcaccaaggactccaacgtggtgctggagatcccagctgccaccaccattgcctacggtgtcattgagttatacgtgaaactggacggccagttcgagttctgccttctccgagggaagcaaggtggcttcgagaacaagaagagaattgactctgtctacctggaccccctggtctttcgagagtttgcattcatagacatgccagatgctgcgcatgggatatcttcccaggatggaccattaagtgttttaaagcaagcgaccctgctcctggagaggaatttccatccatttgcggagctgcctgagccacaacagacagctttgagtgacatcttccaggcggtcctatttgatgatgaactactcatggtcctggaaccagtgtgcgatgacctggtcagcggcctctcgcccacagtggcggtgctgggggagctgaagccccggcagcagcaggaccttgtggccttcctgcagctggtggggtgcagcttacagggtgggtgtccgggccccgaggatgcaggcagcaagcagctgtttatgacagcctacttcttggtcagtgccctcgcagaaatgccagatagcgcagcagctctgctgggcacttgctgcaaactccagatcattcccacactgtgccacttgcttcgtgctctgtctgatgatggagtatctgatcttgaagacccaaccttgactcccctgaaagatacagaaaggtttgggattgtgcagcgcttgtttgcctcagctgacattagtctggagagactgaagtcatctgtgaaagctgtcattctgaaggactctaaagtcttcccactgcttctttgtataaccctgaatggactctgtgctttaggcagagaacattcatgatgtcatatgtgaactagaagtacgtgttactggccaaggctatttttcagaactgttaaaggtcatatgcacgttaaaagttgaccaatgaaatgaatttacagaacagtttaagaagtggtgacattttgcatgatgaatgacctgacttttagccaccaggtactctttaaacagttttccttatcagaggccctcctgtgctggtgacccagcatctgagttaggttccagcatgtaaagagctgggagggcggagaattcttagcatacattcagacgttttttctgcacaataataagtccatctgtcacttgcattccactttttgttacatagaaagagtctgaccctttaatccaaaaggtctttttacattgtgaatgctgtgggaaggcaatttctctgcacacaagaggctacgttttggaagtgatgtatgttatttgatgactgaaaatgaactgtaaatgctcctagagtatattcctctgctgaacaaaattaaacttcaaaaaaatctaacagtaacacacccctgcttgggaccctagctatatgcattttatgtgaccttgccatgcttcagtgaacatactaattctatgtctagcacatgttgatttcctatgtattctgggtattctattaaaggaaactttgaactatg

SEQ ID NO: 17 - DNA, 2801 bp, Homo sapiens
gcggccgcgtctgcctggcccgtcccctccagcccagctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaacggaagtactactacgaagctgcctttctggccatccttgagaaaaatagacagatggccaaggagaggggcctaataagccccagtgattttgcccagctgcaaaaatacatggaatactccaccaaaaaggtcagtgatgtcctaaagctcttcgaggatggcgagatggctaaatatgtccaaggagatgccattgggtacgagggattccagcaattcctgaaaatctatctcgaagtggataatgttcccagacacctaagcctggcactgtttcaatcctttgagactggtcactgcttaaatgagacaaatgtgacaaaagatgtggtgtgtctcaatgatgtttcctgctacttttcccttctggagggtggtcggccagaagacaagttagaattcaccttcaagctgtacgacacggacagaaatgggatcctggacagctcagaagtggacaaaattatcctacagatgatgcgagtggctgaatacctggattgggatgtgtctgagctgaggccgattcttcaggagatgatgaaagagattgactatgatggcagtggctctgtctctcaagctgagtgggtccgggctggggccaccaccgtgccactgctagtgctgctgggtctggagatgactctgaaggacgacggacagcacatgtggaggcccaagaggttccccagaccagtctactgcaatctgtgcgagtcaagcattggtcttggcaaacagggactgagctgtaacctctgtaagtacactgttcacgaccagtgtgccatgaaagccctgccttgtgaagtcagcacctatgccaagtctcggaaggacattggtgtccaatcacatgtgtgggtgcgaggaggctgtgagtccgggcgctgcgaccgctgtcagaaaaagatccggatctaccacagtctgaccgggctgcattgtgtatggtgccacctagagatccacgatgactgcctgcaagcggtgggccatgagtgtgactgtgggctgctccgggatcacatcctgcctccatcttccatctatcccagtgtcctggcctctggaccggatcgtaaaaatagcaaaacaagccagaagaccatggatgatttaaatttgagcacctctgaggctctgcggattgaccctgttcctaacacccacccacttctcgtctttgtcaatcctaagagtggcgggaagcaggggcaaagggtgctctggaagttccagtatatattaaaccctcgacaggtgttcaacctcctaaaggatggtcctgagatagggctccgattattcaaggatgttcctgatagccggattttggtgtgtggtggagacggcacagtaggctggattctagagaccattgacaaagctaacttgccagttttgcctcctgttgctgtgttgcccctgggtactggaaatgatctggctcgatgcctaagatggggaggaggttatgaaggacagaatctggcaaagatcctcaaggatttagagatgagtaaagtggtacatatggatcgatggtctgtggaggtgatacctcaacaaactgaagaaaaaagtgacccagtcccctttcaaatcatcaataactacttctctattggcgtggatgcctctattgctcatcgattccacatcatgcgagagaaatatccggagaagttcaacagcagaatgaagaacaagctatggtacttcgaatttgccacatctgaatccatcttctcaacatgcaaaaagctggaggagtctttgacagttgagatctgtgggaaaccgctggatctgagcaacctgtccctagaaggcatcgcagtgctaaacatccctagcatgcatggtggctccaacctctggggtgataccaggagaccccatggggatatctatgggatcaaccaggccttaggtgctacagctaaagtcatcaccgaccctgatatcctgaaaacctgtgtaccagacctaagtgacaagagactggaagtggttgggctggagggtgcaattgagatgggccaaatctataccaagctcaagaatgctggacgtcggctggccaagtgctctgagatcaccttccacaccacaaaaacccttcccatgcaaattgacggagaaccctggatgcagacgccctgtacaatcaagatcacccacaagaaccagatgcccatgctcatgggcccacccccccgctccaccaatttctttggcttcttgagctaagggggacacccttggcctccaagccagccttgaacccacctccctgtccctggactctactcccgaggctctgtacattgctgccacatactcctgccagcttgggggagtgttccttcaccctcacagtatttattatcctgcaccacctcactgttccccatgcgcacacacatacacacaccccaaaacacatacattgaaagtgcctcatctgaataaaatgacttgtgtttcccctttgggatctgctaaaaaaaaaaaaaaaaaaaaaaaaaaaaaaa

SEQ ID NO: 18 - DNA, 4974 bp, Homo sapiens
agcccggctccgggccagcatccgagagcccggactggaggtgagttcgcagccggaacgttgcaggcacttgtttcctcagtggatgcctttcggcgcgccgccgcccggcgccgcgggactgggagaccggggtctcactcttgcccgggctggccttgaactcctgggctcaagccatctacctgcctcgacctcccagagtgttgggattacagtctgtcctgccgctctgtggagctgcgcctgccaactcattgctttctgctgtgctgtgatcctgcagtcagttgccgctgttgctactgcaatcatttgcaccaaactgagccagagaagttccctcttttaacataaagagtcaagaaattggagcatggctatgagcaatggaaacaatgattttgtggttctgagcaacagcagcatcgcaaccagtgctgctaacccgagtcccctcaccccctgtgatggagaccatgcagcccagcagctcacacccaaagaagcaacaagaacaaaagtgagtccaaatggatgcctgcaacttaatggcacggtcaaatcatcctttctgcctttagacaaccaaagaatgcctcagatgttaccccaatgctgccatccttgcccataccatcaccctttgactagccatagcagtcaccaagagtgccatcccgaggctggccctgcagcaccctctgctttggcctcgtgttgcatgcagccacactccgagtattctgcatctctttgtccaaatcattcacctgtgtatcagactacgtgctgtcttcagccctctccatccttctgcctgcatcatccgtggcctgaccattttcagcatcagcctgtgcaacagcacatagccaacataagaccatccagacctttcaagttgccaaaaagttatgcagccctgatagccgactggccggtggtggtcttgggcatgtgcaccatgttcatcgtagtctgtgccttggttggagtattagtgccagagctccctgacttctctgatccattgctgggttttgaaccaagaggaacagcaataggccagagattggtcacatggaataatatggtgaaaaatacaggatacaaagcaacattagcaaattatccctttaaatatgcagatgaacaagccaaaagccatcgggatgatagatggtcagatgatcattatgaaagagagaaaagagaagttgactggaacttccacaaggacagctttttctgcgacgttccaagtgaccgatattccagagtggtatttacttcatctggaggggagacattatggaatttacctgcaattaaatcaatgtgcaatgtagataattccaggatcagatctcatccccagtttggtgatctctgccagaggaccactgctgcctcctgctgccccagctggacactgggaaactacatcgccattctgaacaatagatcgtcctgtcagaaaatagttgagcgagacgtttctcataccttgaagctgcttcggacttgtgccaaacactaccaaaatggcactctggggccagactgctgggacatggcagccagaagaaaggaccagctcaagtgcaccaatgtgccacgcaaatgtaccaagtacaatgctgtgtaccagatcctccattacttggtggacaaagactttatgaccccaaagacggctgactatgccacgccagctttaaaatacagcatgctcttctctcccacagagaaaggggagagcatgatgaacatttacttggacaactttgaaaactggaactcttctgacggcgtgactaccatcaccgggattgagtttggtatcaaacacagtttgtttcaggattatcttctaatggatactgtgtatcctgccatagccattgtgattgtccttttagttatgtgtgtctacaccaagtccatgtttatcactctgatgacaatgtttgcaataatcagttctttgattgtttcctattttctctatcgtgtagtatttcacttcgaattttttccttttatgaacctcactgccctcattattttggttggaattggagcagatgatgcttttgtcctgtgtgatgtttggaactacacaaaatttgataagcctcatgccgaaacctcagaaacagtaagcatcaccttgcagcacgctgccctctccatgttcgtcaccagttttaccactgctgctgccttttatgctaactatgttagcaacattacagcaatccgatgctttggggtttatgcggggacagctatattggtgaattacgttttgatggtcacatggcttccagcagttgttgtgctgcatgagcggtatcttcttaatatattcacttgcttcaaaaagccccagcagcaaatatatgataacaaaagctgctggacagtggcttgccagaagtgccacaaagtactctttgccatttcagaagcatctcgaatttttttcgaaaaagtattgccatgcattgtcattaagtttcgctacctttggctgttttggttccttgccttaactgtaggtggggcctacattgtatgtataaatccaaagatgaaactgccctcactggagttatccgagttccaggtgttccggtcgtcccatccttttgagcgttatgatgctgaatacaaaaagcttttcatgtttgaacgtgttcaccatggcgaggagctccacatgcccatcacagtaatctggggcgtgtccccagaagacaatggcaacccactaaatcccaagagtaaagggaagttgacattagatagcagttttaacatcgccagcccagcttcccaggcctggattttgcacttctgtcaaaaactgagaaaccaaacattcttttaccagactgatgaacaggacttcaccagctgcttcattgagacattcaaacagtggatggaaaaccaggactgtgatgagcctgccctgtacccatgctgcagccactggagcttcccctacaagcaagagatttttgaactgtgcatcaagagagctatcatggagctggaaaggagtacagggtaccatttggatagcaaaaccccagggccgaggtttgatatcaatgatactatcagggcagtggtgttagagttccagagtacctacctcttcacactggcttatgaaaagatgcatcagttttataaagaggtggactcgtggatatccagtgagctgagttcggcccctgaaggcctcagcaatggttggtttgtcagcaatctggagttctatgacctccaggatagcctctccgatggcaccctcattgccatggggctgtcagttgctgttgcatttagcgtgatgctgctgacaacttggaacatcatcataagcctttatgccatcatttcaattgctggaacgatatttgtcactgttggttctcttgtcctgctgggctgggagctcaatgtgttggaatctgtcaccatttcggttgccgtcggcttgtctgtagactttgccgtccattatggggttgcctaccgcttggctccagatcccgaccgagaaggcaaagtgatcttctctctgagtcgcgtgggctctgcgatggccatggctgccctgaccaccttcgtggcaggggccatgatgatgccctccacagttctagcttacacccagctgggcaccttcatgatgctcatcatgtgtatcagttgggctttcgccaccttctttttccagtgcatgtgccggtgccttggaccacagggtacctgtggtcagattcctttacctaaaaaactacagtgcagtgccttttcccatgccttgtctacaagtcccagtgacaagggacaaagcaaaacacataccataaatgcttatcatttagatcccaggggcccaaaatctgaactggagcatgagttttatgaattagaacctctggcttcccacagctgcactgcccctgagaagaccacttatgaagagacccacatctgctctgaatttttcaacagccaagcaaagaatttagggatgcctgtgcatgcagcttacaacagtgaactcagcaaaagcactgaaagtgacgctggctctgccttgttacagccccctcttgaacagcataccgtgtgtcacttcttctctctgaatcagagatgtagctgcccagatgcctacaaacacttgaactatggcccacactcttgccagcagatgggggactgcttgtgccaccagtgctctcctaccactagcagctttgtccagatccaaaacggcgtggcacctctgaaggccacacaccaagctgtcgagggctttgtgcaccccatcacgcacatccaccactgtccctgcctgcagggcagagtaaagccagccggaatgcagaattctctgcctaggaattttttcctccacccagtgcagcacattcaggcccaagaaaaaattggcaagaccaatgtacacagtcttcagaggagcatagaagagcatcttccaaagatggcagagccatcgtcatttgtctgcagaagcactggatcgttactcaaaacgtgttgcgaccccgagaataaacaaagggaactctgtaaaaatagagacgtgagcaatctggagagcagtggagggactgaaaacaaggcaggagggaaagtggagctgagcttgtcacagacggatgcaagtgtgaactcagaacatttcaatcagaatgaaccaaaagtcctatttaatcatttaatgggggaggctggttgtaggtcttgcccaaataattcacaaagttgtggcagaattgtgagagtgaagtgcaattctgtggactgtcaaatgccaaacatggaagccaatgtgcctgctgtattaacacactcggaactttctggtgaaagtttgttaataaaaacactataataaatgcagcattcaattcagaa

SEQ ID NO: 19 - DNA, 2566 bp, Homo sapiens
gagctattttgaaagtgaccctgggctggggcgccggggcgagcgcggcggcgcggaaccatgacagaagatgaccgaggcggcgctggtggagggccaggtcaagctgcgggacggcaagaagtggaagagtaggtggctggtgctgcggaagccgtcgcccgtggcagactgcctgctgatgctggtctacaaggacaagtcggagcgtatcaagggcctgcgggagcgcagcagcctgacgctagaggacatctgcgggctggagcccggcctgccctacgagggcctggtccacacgctggccattgtctgcctgtcccaggccatcatgctgggctttgacagccacgaggccatgtgtgcgtgggatgcccggatccgctatgcgctcggcgaggtgcataggttccatgtgacagtggctccaggcaccaagttggagagcggcccggctaccctgcacctctgcaatgatgtcctcgtcttggccagggacatccccccggctgtcacggggcagtggaagctgtctgacctccggcgctacggggccgtgccaagcggattcatctttgaaggcgggaccaggtgtgggtactgggctggcgtcttcttcctgtcctcggccgagggggagcagatcagcttcctgttcgactgcatcgtccgaggcatctcccccaccaagggcccctttgggctgcggccggttctaccagacccaagtcccccgggaccctcgactgtggaggagcgtgtggcccaggaagccctggaaaccctacagctggagaagcggctgagcctcctctcacatgcgggcaggccgggcagtggaggggatgaccgcagcctgtccagctcatcctcagaggccagtcacttggacgtcagcgccagcagccggctcaccgcatggccagagcaatcctcgtcgtcagccagcacgtcacaggaggggcctagaccagcagctgcccaggccgccggggaagccatggtgggtgcctcaaggccaccccccaagccgctgcgtccgcggcagctgcaggaggttggccgccagagctcctcggacagcggcatcgccactggcagccactcctcttactccagcagcctctcgtcctacgcgggcagcagcctggacgtgtggcgggccacagatgaactgggctcactgctcagcctgccagcagcgggggcccccgagcccagcctgtgcacctgcctgcccgggacagtcgagtaccaggtgcccacctccctgcgggcccactatgacacaccacgcagcctttgcctggctcctagagaccacagccccccctcacagggcagccccggcaacagtgcggccagggactcaggcggccagacgtccgccgggtgtccctctggctggctgggcacgagacggcggggcctggtgatggaggccccccagggcagcgaggccacactgcctggccctgcccctggcgagccctgggaagcaggcggcccccacgcggggccacccccggctttcttttcggcatgtccagtctgtggaggactcaaggtaaacccccctccttgagagccgcagatcccgccccgcggctgcaaaggggctgaatttgcccccagatggcagaggaagtggcgccagcctccttgcagactggtgctctgtgttctgtgggagggaccgggggtctcccggagaggggagctggagggcgcgccctgtggctgccaccggaggaaggggctgacttggggaggtgagttctggaaggcaggggctctgggtccggcaggtcggggtcaccagagccccaatgctcagctgcttcactccgtgtcccccacccctgaggatcaggtgagtgctgcacctctgttggctcgtgccttgcactggggtgccaagggctggaggccctgccgctggccttgtcctccttgggcctcacgcccccttcgggggtggccggttctccccatcacctctctggggcagtcacaccacctgttaagcatcaagctaccacagaggctccggccacctgggctccaccagcccagcccccctgggctccgtgtgcgctgggcctcatccccatctatgggaggaaactgaagctcaggaggctgtgtggcttgcggggtctctgggttctgggccccactgttccccagtgaagcccttgtgggaaggttccgggagcaggtggtgtcctcagagcagcctcgcctgctgaccccactgggagaggcgccgtgcctcgggcccctggtgggagctctgctggctcctgtctgaacctcctcgcagggccaaaggctggcttggcctgtgtttcccctggcccaggcctcagcccctgcgtcggaggtggggctgtgttgggcccattgtcccccgccctgggtggcttcctcttgcacagcctggagcctgccctgaccacagcccagcagctccctgtgaacacctctttgtcccttcactgtcagctgtttctaaacccagacactgtttgtaatagactggaaataaaatgttctttcctta

SEQ ID NO: 20 - DNA, 3361 bp, Homo sapiens
gtttaattggggctgtcaggccgcggtgcgcgcggagggccgggcgggcgggcgggacggaggccgggaggccgggaggccggggcggcgggcgcgcagctcggcgggaggcgggcgcccggagacgcggctggggcccgcgcggccggggcgccgtcccagggcagggctgcccggccccggccccgggccgcccgcgctccccatgaaaaaccagctccgcggccccccagcgcgggcgcacatgtcgacttcgggggcggcggcggctgggggcacccgggcggggtccgagcccggtgcggggtcggggtccggcgcaggcaccggggcgggcgcggcgacgggggcaggggccatgccctgcaagagcgccgagtggctgcaggaggagctggaggcgcgcggcggcgcgtccttgctgctgctcgactgccggccgcacgagctcttcgagtcgtcgcacatcgagacggccatcaacctggccatcccgggcctcatgttgcgccgcctgcgcaagggcaacctgcccatccgctccatcatccccaaccacgccgacaaggagcgcttcgccacgcgctgcaaggcggccaccgtgctgctctacgacgaggccacggccgagtggcagcccgagcccggcgctcccgcctccgtgctcggcctgctcctacagaagctgcgcgacgacggctgccaggcctactacctccaaggtggtttcaacaagtttcaaacagagtactctgagcactgcgagaccaacgtggacagctcttcctcgccgagcagctcgccacccacctcagtgctgggcctggggggcctgcgcatcagctctgactgctccgacggcgagtcggaccgagagctgcccagcagtgccaccgagtcagacggcagccctgtgccatccagccaaccagccttccctgtccagatcctgccctacctctacctcggctgcgccaaggactccaccaacctggacgtgctcggcaagtatggcatcaagtatatcctcaatgtcacacccaacctacccaacgccttcgagcacggcggcgagttcacctacaagcagatccccatctctgaccactggagccagaacctctcccagttcttccctgaggccatcagcttcattgacgaagcccgctccaagaagtgtggtgtcctggtgcactgcctggcaggcatcagccgctcagtgacggtcactgtggcctatctgatgcagaagatgaacctgtcactcaacgacgcctacgactttgtcaagaggaaaaagtccaacatctcgcccaacttcaacttcatggggcagctgctggactttgagcggacgctggggctaagcagcccgtgcgacaaccacgcgtcgagtgagcagctctacttttccacgcccaccaaccacaacctgttcccactcaatacgctggagtccacgtgaggcctggtgcacggggggcatggcaccaggcccctgctcggctctccacagggctaggtgggagagcccaagcccgccacctctggcctgaggaacccccagatgtcacctgtgcccagaggcccaggctgatcggtgtcggagcgcccctcaccatccttgggggcagggcccgcaggcaaggtctcccactgcagggcttgctggagaggcctcggctcttggacacgtggctttgggcgtccaccagggcctcatcctgtccaggacgctcctttctgctgacagcccagccagtttggctgttttttaaagacacatccacggacctgagtttactttttacttttggcaggtaaatccaagctccctggagcacaaagagtgtttgagctcttcttgatttttcttttttttttttttttttaacaaaaagtgttattttcaggctacatgcaacagtggattgtataacccagtatttcatccctttcctgatcctgcaagagagagaaatgttcagttttgtttttcgttcaatttcaaaaagcaagtatcgtgtttgtttttgtttttgttttttaatggaaaagacagacgccatgttgaccttgaccaaatgcgttttgcacatgtgtgaagcctctgtttcctcagcgggcccttcttgaaggggtggcttactgctcttcaggtattgggacccccagtcgtgccgcctcccacccttggcccagtctgacttagctctgcattcgcctgtgatgactgctgcaagttgtgattggtgggctggatggtggtctttgcattttctgccgtctcatccatccctctggtggtccctgcagacctccctgaggcagaaggtggggaccctggggccctgccgctgtcccccaggaggtgggccgcagggggctgccaggcagtagcattagccctctggggtcagcccctaagaaggcctgggctctgagcccttttatatacttagccactacttctgtctgtctgtctgtctctctctcttcctctccctctctctctttctctctctccctctctctctctttctttctctctccccccctccctctctcttcctttcctctctcttgttgtaactgggagtggaggcccagtggctggggagacattaggtggtggggcccagcccgacctccaggttcttccttctccctagctgttgctttggtctggccactcccagcccccttgtccccttggaagcttgccctgccctcatcttgcccatgccttctactgccaggagacttgcacccatttcaaccctagggcgggggcaagtggggcaaggatggaccagcagaaggggggtaaggctctgttcacttccccctgcctccacagaacgaagccacggattccgttatcttcctccagttttgttccttctccagcctcagttccaccaggtgtcaggactgcatgggggcctggggcaggcagaggagtcaggccagggtccctgacggagcagcactcagcatgtgagtgaggccacagaaaaactctgccccactgcttcttacctcacgggggtggctttcagggattctttagcgcagcagattaaaatcttgccacagtcgagaaattgacaacaagcttccatgctgtacatggttctctttttctctcttttatttttaaaaagaaaacccagaaagatgtaccagatttgtgtaaatgagggtatgccagaaggtggccagttttgctttatgatcttatgaaggaagatttgtgaccctacgtatatatatacacacacatacatatatatatatatcccgaaccaacaacgggactttgtttatattgcaaataaatattattttttctttaaaa

SEQ ID NO: 21 - DNA, 3512 bp, Homo sapiens
ctttttcgcaacgggtttgccgccagaacacaggtgtcgtgaaaactacccctaaaagccaaaatgggaaaggaaaagactcatatcaacattgtcgtcattggacacgtagattcgggcaagtccaccactactggccatctgatctataaatgcggtggcatcgacaaaagaaccattgaaaaatttgagaaggaggctgctgagatgggaaagggctccttcaagtatgcctgggtcttggataaactgaaagctgagcgtgaacgtggtatcaccattgatatctccttgtggaaatttgagaccagcaagtactatgtgactatcattgatgccccaggacacagagactttatcaaaaacatgattacagggacatctcaggctgactgtgctgtcctgattgttgctgctggtgttggtgaatttgaagctggtatctccaagaatgggcagacccgagagcatgcccttctggcttacacactgggtgtgaaacaactaattgtcggtgttaacaaaatggattccactgagccaccctacagccagaagagatatgaggaaattgttaaggaagtcagcacttacattaagaaaattggctacaaccccgacacagtagcatttgtgccaatttctggttggaatggtgacaacatgctggagccaagtgctaacatgccttggttcaagggatggaaagtcacccgtaaggatggcaatgccagtggaaccacgctgcttgaggctctggactgcatcctaccaccaactcgtccaactgacaagcccttgcgcctgcctctccaggatgtctacaaaattggtggtattggtactgttcctgttggccgagtggagactggtgttctcaaacccggtatggtggtcacctttgctccagtcaacgttacaacggaagtaaaatctgtcgaaatgcaccatgaagctttgagtgaagctcttcctggggacaatgtgggcttcaatgtcaagaatgtgtctgtcaaggatgttcgtcgtggcaacgttgctggtgacagcaaaaatgacccaccaatggaagcagctggcttcactgctcaggtgattatcctgaaccatccaggccaaataagcgccggctatgcccctgtattggattgccacacggctcacattgcatgcaagtttgctgagctgaaggaaaagattgatcgccgttctggtaaaaagctggaagatggccctaaattcttgaagtctggtgatgctgccattgttgatatggttcctggcaagcccatgtgtgttgagagcttctcagactatccacctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtttcaattggccatttaagtttagtagtaaaagactggttaatgataacaatgcatcgtaaaaccttcagaaggaaaggagaatgttttgtggaccactttggttttcttttttgcgtgtggcagttttaagttattagtttttaaaatcagtactttttaatggaaacaacttgaccaaaaatttgtcacagaattttgagacccattaaaaaagttaaatgagaaacctgtgtgttcctttggtcaacaccgagacatttaggtgaaagacatctaattctggttttacgaatctggaaacttcttgaaaatgtaattcttgagttaacacttctgggtggagaatagggttgttttccccccacataattggaaggggaaggaatatcatttaaagctatgggagggttgctttgattacaacactggagagaaatgcagcatgttgctgattgcctgtcactaaaacaggccaaaaactgagtccttgtgttgcatagaaagcttcatgttgctaaaccaatgttaagtgaatctttggaaacaaaatgtttccaaattactgggatgtgcatgttgaaacgtgggttaaaatgactgggcagtgaaagttgactatttgccatgacataagaaataagtgtagtggctagtgtacaccctatgagtggaagggtccattttgaagtcagtggagtaagctttatgccagtttgatggtttcacaagttctattgagtgctattcagaataggaacaaggttctaatagaaaaagatggcaatttgaagtagctataaaattagactaatctacattgcttttctcctgcagagtctaataccttttatgctttgataattagcagtttgtctacttggtcactaggaatgaaactacatggtaataggcttaacaggtgtaatagcccacttactcctgaatctttaagcatttgtgcatttgaaaaatgcttttcgcgatcttcctgctgggattacaggcatgagccactgtgcctgacctcccatatgtaaaagtgtctaaaggtttttttttggttataaaaggaaaatttttgcttaagtttgaaggataggtaaaattaaaggacatgctttctgtttgtgtgatggtttttaaaaattttttttaagatggagttcttgttgcccaggctagaatgcaatggcaaaatctcactgcaatctcctcctcctgggttcaagcaattctcctacttcagcctcccaagtagctgggattacaggcatgtgctaatttggtgtttttaatagagatgaggtttttccatgttggtcaggctggtctcaaactcctgaccttaggtgatcgcctcggcctcctaaagtgctggaattacaggcatgagccaccatgcctggccaggacatgtgttcttaaggacatgctaagcaggagttaaagcagcccaagagataaggcctcttaaagtgactggcaatgtgtattgctcaagattcaaaggtacttgaattggccatagacaagtctgtaatgaagtgttatcgttttccctcatctgagtctgaattagataaaatgccttcccatcagccagtgctctgaggtatcaagtctaaattgaactagagatttttgtccttagtttctttgctatctaatgtttacacaagtaaatagtctaagatttgctggatgacagaaaaaacaggtaaggcctttaatagatggccaatagatgccctgataatgaaagttgacacctgtaagatttaccagtagagaattcttgacatgcaaggaagcaagatttaactgaaaaattgttcccactggaagcaggaatgagtcagtttacttgcatatactgagattgagattaacttcctgtgaaacccagtgtcttagacaactgtggcttgagcaccacctgctggtattcattacaaacttgctcactacaataaatgaattttaagctttaa

SEQ ID NO: 22 - DNA, 3158 bp, Homo sapiens
ctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtga

SEQ ID NO: 23 - DNA, 3303 bp, Homo sapiens
atgcgagctggacagcagtgggaggtttgtgaggctcgcactggccgcagaccctcgggctcgatcgcccgggagccaggactcggcgacgcgaggctgccgggctacccggccgaggcttcgggggcgcaaactaatgggactggctcgctcggcagcatctccccgctcttctaagtacactgagcagggcccgcgctgaagtagaagctgtccgggggcgcgtagcccggagtcccagtgtggcccggaggaacggagcccgtgccagggcggcccagtcgggagcccggggaccgagcttgtgctgtggggaaacccccacttcttccaagggacagcgatcccgggacggtcgaggcgtcggggcggtcaccgagacctctgcgggaagaccccgtcggggagagggcgcgcagccccgaagcgtctcgggaagtcgagcggaatcgggcgggatcacccgggggcgcagagcccccgtcgcgcctcgtgcggcagcggagagcccaggagaacgagccctcgggggccgaagcccatgcccgggttgggggcggctgcccagtgagtcctcctggccggccgggcggagaagagcgacaccgaagccggcgggaggggagcacttcaaggccggcggctgcggaggatgggcgcctgagcggctccgagcgcagcgcggcagaggaaggcgaggcgagctttggtgaggaggcgccaagggatcccgaagtgcagtctgcccccgggaagatggctcggcctgggcagcgttggctcggcaagtggcttgtggcgatggtcgtgtgggcgctgtgccggctcgccacaccgctggccaagaacctggagcccgtatcctggagctccctcaaccccaagttcctgagtgggaagggcttggtgatctatccgaaaattggagacaagctggacatcatctgcccccgagcagaagcagggcggccctatgagtactacaagctgtacctggtgcggcctgagcaggcagctgcctgtagcacagttctcgaccccaacgtgttggtcacctgcaataggccagagcaggaaatacgctttaccatcaagttccaggagttcagccccaactacatgggcctggagttcaagaagcaccatgattactacattacctcaacatccaatggaagcctggaggggctggaaaaccgggagggcggtgtgtgccgcacacgcaccatgaagatcatcatgaaggttgggcaagatcccaatgctgtgacgcctgagcagctgactaccagcaggcccagcaaggaggcagacaacactgtcaagatggccacacaggcccctggtagtcggggctccctgggtgactctgatggcaagcatgagactgtgaaccaggaagagaagagtggcccaggtgcaagtgggggcagcagcggggaccctgatggcttcttcaactccaaggtggcattgttcgcggctgtcggtgccggttgcgtcatcttcctgctcatcatcatcttcctgacggtcctactactgaagctacgcaagcggcaccgcaagcacacacagcagcgggcggctgccctctcgctcagtaccctggccagtcccaaggggggcagtggcacagcgggcaccgagcccagcgacatcatcattcccttacggactacagagaacaactactgcccccactatgagaaggtgagtggggactacgggcaccctgtctacatcgtccaagagatgccgccccagagcccggcgaacatctactacaaggtctgagtgcccggcacggcctcaggcccccgagggacagtcggcctggaccggacctctcctttcgcccccacaccccctccccttgccagctgtgcccacctttgtatttagttttgtagtttcttggcttttataatccccctttttccctgccccctgggcttcggaggggggtgcttgtgcccctaacccccatgctcttgtgccttccccctctggccaggcctctgggctccgtgggggcgccccttcttggaaggcagggctggacactgatggacagcaggcagggagacagtcccctggccctgcccctccctcgccccccttgccaccttcccaggactgcttgtccgctatcatcactgtttttaatgcttttgtgttcattttttagctgtcaactcattttcatctgttttttgaagaaaaatggaaaaatgtaaaaggcagcccctccccaggctttgtgagcctggcccaagccagtacaagagggcctggggcacgatgtggtcagccaggaagcataggatgccatttcttttatagattccttggtatttctggtggggtaaggggcaggccagggctgttcacgcccatgagggaagaggaaagtgccactgggcaaggtgtcccaccctcccctcctgaccctcctacgaggcttatcctggcaatggggtagtcactgccacccttccacacacacacacacacacacacacacaaaaaaaaatcccttccttgtgggattcttgggcatctcctgcctccctcactctcacggtaattaatgtcttaattggctgttgcctggggaacaggagagctgctgcaggcagatgacctcatggggggtggagggaggtgaggtgcccaggtggctatttgccctgcagagctgggagtttcacccccaccccccaccctgttctctccttacctttggcatcctttggcctggtggggaaacagaggcccagggtggagacctaagcgggtataagaccaggtggcctgctccttttctgggccctagcacaggtgggtaacccccacccaacccagctcctgctgctgtcccagtcttgggctggggcctggaaagaggaagaggctgcctggggctgggccagcccgctgtgcactttgaccccagttccttgccagcacggctgctaacagactgccacttgagtgcgccttgcaggcactcccagagcagccatggaaggagctggccctcacaccatccacctccacactgcctcctggccagctgcccaccccagtgccaggtgggagagggagcagaacagccagccccttccaggtggcagtcggaagggtttttgtttttgtttctgttgccatttgtgtaaatactagtctttttggaaaaaaaataatgtaaagatgttttgtataaactctgaattattttcttgttgcttttttcttagaaaaaaatgagaactaaaaaaaaaaaattaaccacatgga

SEQ ID NO: 24 - DNA, 3999 bp, Homo sapiens
gggctgcgttcgctccagccgcggctctacagcagcgggcggcgggacccgggacccagcttggcgacggcgatctcgacgcgggcccccaggatctcccggcgccccacctctggagcagcccctgccgccagcgtcaggtccaccccggaatcccagggactctcggcgccgaacggacccgggccgggtgcaacggggtccccggactggagaagacgcgggtggcaccgtgcgagctccaggagccccgggtccactgcgaggcctcggggggcgcagacctgcagagactgcggccaacgggaagaaataaagggattatagtccacccaattcacagacttctgagactcagacacgaggagagatagagaaccgccaatctctaaatcaacaagcaaaggaggtgccaagcctgtttgtcttcattgtgacactggagtctagatgctgggaagtccaagatcagggtgccggcatggtcagttcctggcgaagcctctcttctaggtttcagactgccctcttctttgttgtgtcctcgaatggcagaaaaaggggtggctgttggaggaagggaggagagtaaatgaagagaaagaactggaataaccccttgcagaaaaaaaaaaaaagggaagcaagcttagctgtacaccctgagtcttgcaaaagctgcagccccacccaggagcagggtggtggctggggcgatggtggacgccctgaagatgtcccatggctactgaaggggctgcccagttagggaacagagtggcgggcatggtgtgtagcctatgggtgctgctcctggtgtcttcagttctggctctggaagaggtattgctggacaccaccggagagacatctgagattggctggctcacctacccaccaggggggtgggacgaggtgagtgttctggacgaccagcgacgcctgactcggacctttgaggcatgtcatgtggcaggggcccctccaggcaccgggcaggacaattggttgcagacacactttgtggagcggcgcggggcccagagggcgcacattcgactccacttctctgtgcgggcatgctccagcctgggtgtgagcggcggcacctgccgggagaccttcaccctttactaccgtcaggctgaggagcccgacagccctgacagcgtttcctcctggcacctcaaacgctggaccaaggtggacacaattgcagcagacgagagctttccctcctcctcctcctcctcctcctcctcttcttcctctgcagcgtgggctgtgggaccccacggggctgggcagcgggctggactgcaactgaacgtcaaagagcggagctttgggcctctcacccaacgcggcttctacgtggccttccaggacacgggggcctgcctggccctggtcgctgtcaggctcttctcctacacctgccctgccgtgctccgatcctttgcttcctttccagagacgcaggccagtggggctgggggggcctccctggtggcagctgtgggcacctgtgtggctcatgcagagccagaggaggatggagtagggggccaggcaggaggcagcccccccaggctgcactgcaacggggagggcaagtggatggtagctgtcgggggctgccgctgccagcctggataccaaccagcacgaggagacaaggcctgccaagcctgcccacgggggctctataaggcttctgctgggaatgctccctgctcaccatgccctgcccgcagtcacgctcccaacccagcagcccccgtttgcccctgcctggagggcttctaccgggccagttccgacccaccagaggccccctgcactggtcctccatcggctccccaggagctttggtttgaggtgcaaggctcagcactcatgctacactggcgcctgcctcgggagctggggggtcgaggggacctgctcttcaatgtcgtgtgcaaggagtgtgaaggccgccaggaacctgccagcggtggtgggggcacttgtcaccgctgcagggatgaggtccacttcgaccctcgccagagaggcctgactgagagccgagtgttagtggggggactccgggcacacgtaccctacatcttagaggtgcaggctgttaatggggtgtctgagctcagccctgaccctcctcaggctgcagccatcaatgtcagcaccagccatgaagtgccctctgctgtccctgtggtgcaccaggtgagccgggcatccaacagcatcacggtgtcctggccgcagcccgaccagaccaatgggaacatcctggactatcagctccgctactatgaccaggcagaagacgaatcccactccttcaccctgaccagcgagaccaacactgccaccgtgacacagctgagccctggccacatctatggtttccaggtgcgggcccggactgctgccggccacggcccctacgggggcaaagtctatttccagacacttcctcaaggggagctgtcttcccagcttccagaaagactctccttggtgatcggctccatcctgggggctttggccttcctcctgctggcagccatcaccgtgctggcggtcgtcttccagcggaagcggcgtgggactggctacacagagcagctgcagcaatacagcagcccaggactcggggtgaagtattacatcgacccctccacctacgaggacccctgtcaggccatccgagaacttgcccgggaagtcgatcctgcttatatcaagattgaggaggtcattgggacaggctcttttggagaagtgcgccagggccgcctgcagccacggggacggagggagcagactgtggccatccaggccctgtgggccgggggcgccgaaagcctgcagatgaccttcctgggccgggccgcagtgctgggtcagttccagcaccccaacatcctgcggctggagggcgtggtcaccaagagccgacccctcatggtgctgacggagttcatggagcttggccccctggacagcttcctcaggcagcgggagggccagttcagcagcctgcagctggtggccatgcagcggggagtggctgctgccatgcagtacctgtccagctttgccttcgtccatcgctcgctgtctgcccacagcgtgctggtgaatagccacttggtgtgcaaggtggcccgtcttggccacagtcctcagggcccaagttgtttgcttcgctgggcagccccagaggtcattgcacatggaaagcatacaacatccagtgatgtctggagctttgggatactcatgtgggaagtgatgagttatggagaacggccttactgggacatgagtgagcaggaggtactaaatgcaatagagcaggagttccggctgcccccgcctccaggctgtcctcctggattacatctacttatgttggacacttggcagaaggaccgtgcccggcggcctcattttgaccagctggtggctgcatttgacaagatgatccgcaagccagataccctgcaggctggcggggacccaggggaaaggccttcccaggcccttctgacccctgtggccctggactttccttgtctggactcaccccaggcctggctttcagccattggactggagtgctaccaggacaacttctccaagtttggcctctgtaccttcagtgatgtggctcagctcagcctagaagacctgcctgccctgggcatcaccctggctggccaccagaagaagctgctgcaccacatccagctccttcagcaacacctgaggcagcagggctcagtggaggtctgagaatgacgatacccgtgactcagccctggacactggtccgagaagggacatgtgggacgtgagccgggctccaacagcctctgtgagagatgccccacaccaaacccaaccctcccgatggctgcattccctggtcctccgcctctccaccagccccctcctcattaaagggaaagaagggaatttgca

SEQ ID NO: 25 - DNA, 3888 bp, Homo sapiens
cttccgggaggcggtgacagctgctgagacgtgttgcagccagagtctctccgctttaatgcgctcccattagtgccgtcccccactggaaaaccgtggcttctgtattatttgccatctttgttgtgtaggagcagggagggcttcctcccggggtcctaggcggcggtgcagtccgtcgtagaagaattagagtagaagttgtcggggtccgctcttaggacgcagccgcctcatgggggtccaggggctctggaagctgctggagtgctccgggcggcaggtcagccccgaagcgctggaagggaagatcctggctgttgatattagcatttggttaaaccaagcacttaaaggagtccgggatcgccatgggaactcaatagaaaatcctcatcttctcactttgtttcatcggctctgcaaactcttattttttcgaattcgtcctatttttgtgtttgatggggatgctccactattgaagaaacagactttggtgaagagaaggcagagaaaggacttagcgtccagtgactccaggaaaacgacagagaagcttctgaaaacatttttgaaaagacaagccatcaaaactgccttcagaagcaaaagagatgaagcactacccagtcttacccaagttcgaagagaaaacgacctctatgttttgcctcctttacaagaggaagaaaaacacagttcagaagaggaagatgaaaaagaatggcaagaaagaatgaatcaaaaacaagcattacaggaagagttctttcataatcctcaagcgatagatattgagtctgaggacttcagcagcctgccccctgaagtaaagcatgaaatcttgactgatatgaaagagttcaccaagcgcagaagaacattatttgaagcaatgccagaggagtctgatgacttttcacagtaccaactcaaaggcttgcttaaaaagaactatctgaaccagcatatagaacatgtccaaaaggaaatgaatcagcaacattcaggacacatccgaaggcagtatgaagatgaagggggctttctgaaggaggtagagtcaaggagagtggtctctgaagacacttcacattacatcttgataaaaggtattcaagctaagacagttgcagaagtggattcagagtctcttccttcttccagcaaaatgcacggcatgtcttttgacgtgaagtcatctccatgtgaaaaactgaagacagagaaagagcctgatgctacccctccttctccaagaactttactagctatgcaagctgccctgctgggaagtagctcagaagaggagctggagagtgaaaatcgaaggcaggcccgtgggaggaacgcacctgctgctgtagacgaaggctccatatcaccccggactctttcagccattaagagagctcttgacgatgacgaagatgtaaaagtgtgtgctggggatgatgtgcagacgggagggccaggagcagaagaaatgcgtataaacagctccaccgagaacagtgatgaaggacttaaagtgagagatggaaaaggaataccgtttactgcaacacttgcgtcatctagtgtgaactctgcagaggagcacgtagccagcactaatgaggggagagagcccacagactcagttccaaaagaacaaatgtcacttgttcacgtggggactgaagcctttccgataagtgatgagtctatgattaaggacagaaaagatcggctgcctctggagagtgcagtggttagacatagtgacgcacctgggctcccgaatggaagggaactgacaccggcatctccaacttgtacaaattctgtgtcaaagaatgaaacacatgctgaagtgcttgagcagcagaacgaactttgcccatatgagagtaaattcgattcttctcttctttcaagtgatgatgaaacaaaatgtaaaccgaattctgcttctgaagtcattggccctgtcagtttgcaagaaacaagtagcatagtaagtgtcccttcagaggcagtagataatgtggaaaatgtggtgtcatttaatgctaaagagcatgagaattttctggaaaccatccaagaacagcagaccactgaatctgcaggccaggatttaatttccattccaaaggccgtggaaccaatggaaattgactcggaagaaagtgaatctgatggaagtttcattgaagtgcaaagtgtgattagtgatgaggaacttcaagcagaattccctgaaacttccaaacctccctcagaacaaggcgaagaggaactggtaggaactagggagggagaagcccctgctgagtccgagagcctcctgagggacaactctgagagggacgacgtggatggtgagccacaggaagctgagaaagatgcggaagattcgctccatgaatggcaagatattaatttggaggagttggaaactctggagagcaacctcttagcacagcagaattcactgaaagctcaaaaacagcagcaagaacggatcgctgctactgtcaccggacagatgttcctggaaagccaggaactcctgcgcctgttcggcattccctacatccaggctcccatggaagcagaggcgcagtgcgccatcctggacctgactgatcagacttccggaaccatcactgatgacagtgatatctggctgtttggagcgcggcatgtctatagaaacttttttaataaaaacaagtttgtagaatattatcaatatgtggactttcacaatcaattgggattggaccggaataagttaataaatttggcttatttgcttggaagtgattataccgaaggaataccaactgtgggttgtgtaaccgccatggaaattctcaatgaattccctgggcatggcctggaacctctcctaaaattctcagaatggtggcatgaagctcaaaaaaatccaaagataagacctaatcctcatgacaccaaagtgaaaaaaaaattacggacattgcaactcacccctggctttcctaacccagctgttgccgaggcctacctcaaacccgtggtggatgactcgaagggatcctttctgtgggggaaacctgatctcgacaaaattagagaattttgtcagcggtatttcggctggaacagaacgaagacagatgaatctctgtttcctgtattaaagcaactcgatgcccagcagacacagctccgaattgattccttctttagattagcacaacaggagaaagaagatgctaaacgtattaagagccagagactaaacagagctgtgacatgtatgctaaggaaagagaaagaagcagcagccagcgaaatagaagcagtttctgttgccatggagaaagaatttgagctacttgataaggcaaaaggaaaaacccagaagagaggcataacaaataccttagaagagtcatcaagcctgaaaagaaagaggctttcagattctaaaggaaagaatacatgcggtggatttttgggggagacctgcctctcagaatcatctgatggatcttcaagtgaagatgctgaaagttcatctttaatgaatgtacaaaggagaacagctgcgaaagagccaaaaaccagtgcttcagattcgcagaactcagtgaaggaagctcccgtgaagaatggaggtgcgaccaccagcagctctagtgatagtgatgacgatggagggaaagagaagatggtcctcgtgaccgccagatctgtgtttgggaagaaaagaaggaaactaagacgtgcgaggggaagaaaaaggaaaacctaattaaaaaatatgtatcctctataattagttatgacagccatttgtaatgaatttgtcgcaaagacgtaataaaattaactggtggcacggtc

SEQ ID NO: 26 - DNA, 911 bp, Homo sapiens
acagcaccctcctgaaaactgcagcttccttctcaccttgaagaataatcctagaaaactcacaaaatgtgtgatgcttttgtaggtacctggaaacttgtctccagtgaaaactttgatgattatatgaaagaagtaggagtgggctttgccaccaggaaagtggctggcatggccaaacctaacatgatcatcagtgtgaatggggatgtgatcaccattaaatctgaaagtacctttaaaaatactgagatttccttcatactgggccaggaatttgacgaagtcactgcagatgacaggaaagtcaagagcaccataaccttagatgggggtgtcctggtacatgtgcagaaatgggatggaaaatcaaccaccataaagagaaaacgagaggatgataaactggtggtggaatgcgtcatgaaaggcgtcacttccacgagagtttatgagagagcataagccaagggacgttgacctggactgaagttcgcattgaactctacaacattctgtgggatatattgttcaaaaagatattgttgttttccatgatttagcaagcaactaattttctcccaagctgattttattcaatatggttacgttggttaaataaactttttttagatttagaaggtgatgtaatgatgtattcattgtgcttatgatgtattcttagtcataactgagtgaaggaaatgggaaatttgcattatttctttgttctgatatgaataataacatatttcataataattcaaggtaaaaagggatatctatggatttccctaggtaggagataacaagtatgtaccattactgaatattaaatccttctttaccatagctacagttaagtaggtgtatctcagaaacctaaggtagttttaaatgtagtgaaattg

SEQ ID NO: 27 - DNA, 676 bp, Homo sapiens
acagcacgctgccacgccgacgcagacccctctctgcacgccagcccgcccgcacccaccatggccacagttcagcagctggaaggaagatggcgcctggtggacagcaaaggctttgatgaatacatgaaggagctaggagtgggaatagctttgcgaaaaatgggcgcaatggccaagccagattgtatcatcacttgtgatggtaaaaacctcaccataaaaactgagagcactttgaaaacaacacagttttcttgtaccctgggagagaagtttgaagaaaccacagctgatggcagaaaaactcagactgtctgcaactttacagatggtgcattggttcagcatcaggagtgggatgggaaggaaagcacaataacaagaaaattgaaagatgggaaattagtggtggagtgtgtcatgaacaatgtcacctgtactcggatctatgaaaaagtagaataaaaattccatcatcactttggacaggagttaattaagagaatgaccaagctcagttcaatgagcaaatctccatactgtttctttcttttttttttcattactgtgttcaattatctttatcataaacattttacatgcagctatttcaaagtgtgttggattaattaggatcatccctttggttaataaataaatgtgtttgtgctaa

SEQ ID NO: 28 - DNA, 672 bp, Homo sapiens
cattgcagactttgcacctctggctccagggagctcacaggcaggggctggtccagcccagaggcgatgaagacagtgacgatgatgatggtggtggagatgcaggcgctgactcaggttctgagagctgtgttgtctgcgtgcacatgggtgagccggaaaggagacctgcagagaatgaaacagacacataaaggaaagcctcccagcagcatggctttcaccggcaagttcgagatggagagtgagaagaattatgatgagttcatgaagctccttgggatctccagcgatgtaatcgaaaaggcccgcaacttcaagatcgtcacggaggtgcagcaggatgggcaggacttcacttggtcccagcactactccgggggccacaccatgaccaacaagttcactgttggcaaggaaagcaacatacagacaatggggggcaagacgttcaaggccactgtgcagatggagggcgggaagctggtggtgaatttccccaactatcaccagacctcagagatcgtgggtgacaagctggtggaggtctccaccatcggaggcgtgacctatgagcgcgtgagcaagagactggcctaagcagccaggcccggcccagggagctacaaacccaccaataaaactgatataaggacagacgctaaaaaaaaa

SEQ ID NO: 29 - DNA, 2146 bp, Homo sapiens
gctctggaagggcgggcgagactgtggaggacctggagctggcgggggtcagggtaggggggaggggcagggctcggggttcgggggcggggtgttcacggtgagaccaaaagtcaggcccgcagccgtgccgggtgctcttcagcatgtccttcatcccggtggccgaggattccgacttccccatccacaacctgccctacggcgtcttctcgaccagaggcgacccaagaccgaggataggtgtggccattggcgaccagatcctggacctcagcatcatcaagcacctctttactggtcctgtcctctccaaacaccaggatgtcttcaatcagcctacactcaacagcttcatgggcctgggtcaggctgcctggaaggaggcgagagtgttcttgcagaacttgctgtctgtgagccaagccaggctcagagatgacaccgaacttcggaagtgtgcattcatctcccaggcttctgccacgatgcaccttccagccaccataggagactacacagacttctattcctctcggcagcatgctaccaacgtcggaatcatgttcagggacaaggagaatgcgttgatgccaaattggctgcacttaccagtgggctaccatggccgtgcctcctctgtcgtggtgtctggcaccccaatccgaaggcccatgggacagatgaaacctgatgactctaagcctcccgtatatggtgcctgcaagctcttggacatggagctggaaatggctttttttgtaggccctggaaacagattgggagagccgatccccatttccaaggcccatgagcacatttttggaatggtccttatgaacgactggagtgcacgagacattcagaagtgggagtatgtccctctcgggccattccttgggaagagttttgggaccactgtctctccgtgggtggtgcccatggatgctctcatgccctttgctgtgcccaacccgaagcaggaccccaggcccctgccgtatctgtgccatgacgagccctacacatttgacatcaacctctctgttaacctgaaaggagaaggaatgagccaggcggctaccatatgcaagtccaattttaagtacatgtactggacgatgctgcagcagctcactcaccactctgtcaacggctgcaacctgcggccgggggacctcctggcttctgggaccatcagcgggccggagccagaaaacttcggctccatgttggaactgtcgtggaagggaacgaagcccatagacctggggaatggtcagaccaggaagtttctgctggacggggatgaagtcatcataacagggtactgccagggggatggttaccgcatcggctttggccagtgtgctggaaaagtgctgcctgctctcctgccatcatgagattttctctgctcttctggaaacaaagggctcaagcacccctttcaaccctgtgactggggtcctccctcgggctgtaggcctggtccgccattcagtgacaaataaagccattgtgctctgaggcctgcactgccgcagatgcagctgtgtccacttatgatcgtgatttgatccagtgggtcaaggtgtgtaaagcctccctgccagatattcattaatatgttttctcactcttattagtgaggtcaggggtctttgtgggattttcttattagacatcccaggcctcctggtattccatggaatttgaaaagagactggcacctgtagtagtcagggctctccagagaaatagaaccaaggagaaagagatcgatttattgattgattgattgattttaagcaaattggcttctgggattctggagggtggcaagcccaaaacctgctgggtgggttgctggctggagacccaaggaagagctgcagtttgagtctgaagcagtctgctgtcaaaatttcctcttcctctgggaagtgagtcattgtttggtgaaggccatcaactgattagatgaggcccagccacactgtgggggtcttctgctttactccactgatttaagttttatttcacctaaaaagtactttcttagaaacatgtagaatagcatttgagcaaatatttgggtaccttagtctagccaaattaatacagaaaactgcccatcacagca

SEQ ID NO: 30 - DNA, 4928 bp, Homo sapiens
ccagtcccgctccctcctcctctccgtgcctctttctccgccctgctccccgccaaacacacttgcacaggggctctcaaggtgttctccgcacagcggaagatggcgacagactgagggtgcatggccagcgggagccacggggccgtgccgctgggctgcagccacagcggtgcgaacgagaggcggaagcgagaggcgcactaagtaaagcccggtgtctgcgtccggcgcctgtggcgctgccgggagccaggtggcccgcccgagccggaactccaggagcagcgggtgcggagccagagcggagcccgccagggactggccccggcgaacacccggagcgcgaacgaagcccgaagggcccggcaacggaccggccggccggcctaggagggcgcgagcgaggcagggagcggcgtggagcgggcagcgggcggacgggcgggagcggagcggcgcggggcgaggggagcggagcggagcgcggcggcggggcccgcacggcggcgctgaggggcgcagagctgcgccgaaccgagacggccggtttggagtgcgagccgggcggccgccggcgcggagtgaagtggcacggagccgagggcagctgaggggcccgacactatgaggagtgcggcgccgccgccgcagccgccaccgccccagtgccccgcaccgcccccagccgggacgccgggcagcgcctagcgggccgggcggcggcgcccgggctgagagcgacggagcgcgggagcggcgcggagacggcaccagagcgccccgcgactccggcctgagcggggcatcgcgccggccggcctgcctcaccatgcagcccccgaggtagagcctggacggcgccgaggagcgcagagcggcgcgcagcccgcccgccccagacggccgtctggcctcgcgcctgcctgttccctccagcccggacccccctgaaatatgttcaggggcgcttggatgtggcccgggaaagacgccgccgcgctgactatctgctgctgctgctgctgctgggctcccaggccgagcgacaaaccttgcgccgactccgagcgggcgcagcgatggcgactgtccctggcgtccctgctcttcttcaccgtgctgctcgctgaccatctgtggctgtgcgcgggggcccggccccgggccagggagctgagcagcgccatgcggcccccatggggggccggccgggagcggcagccggtgcctcctcgcgcggtgctgccgctgccgccgccgccgcccggcgagcccagcgcgcccccaggcacctgcggccccagatacagcaacctgaccaaagccgcccccgccgccggctctcggccggtctgcggcggcgtcccagagcccacggggctggacgcagcttgcaccaaattgcaatctttgcagagacttttcgaaccgactactccggccccccctctgcggccccctgactccctttcccgtgccccggccgagttcccctccgccaaaaaaaacttgctcaaaggccactttcggaacttcactctctccttttgcgacacctacacggtctgggacttgctgctgggcatggaccgccccgacagcctggactgtagcctggacaccctgatgggggacctgctggccgtggtggccagcccgggctccggggcctgggaggcgtgtagcaactgtatcgaggcgtaccagcggctggaccgacacgctcaggaaaaatatgacgagttcgacctcgtgctgcataaatacttacaggcggaagagtactcaatccggtcctgcacgaaaggctgtaaggctgtctacaaggcctggctgtgctcagaatacttcagcgtgacccagcaggaatgccagcgctgggtgccctgcaagcaatactgcctggaggtgcagacccggtgcccctttatactccccgacaatgaggaaatggtgtacggagggctccctggctttatctgtacagggttgctggatacttcaccaaagcgtctggaaaccaagtgctgtgacgtgcagtgggtctcctgtgaggcgaagaagaagaagttcaaggagtctgaggcccccaaaacccaccagcagcaattccaccactcctatttccaccactaccaccaacagtaccatcactaccacccccatcatgatcccccaggccgtgtcagcaacaagcccgccctgctgccggtctctgggggctcccgcctcagccctagcaggatccggctctgcgtccttgttctcatgctcctccataccgtggtgtccttctccagcaaccagggtggtgggggattggggctggagacactgcctgccctagaggagggcctgacacgggaagagtgacagtagggagggaggacagacctccaccacactgacatcagctccagctcccccaggttgggggggagggggctcctcccatgggaggtgtaggataaggtgggggcgggggaaatgggggaatgacacatcccccccaacctacccccaccccaaaagcagctccaacagaatggccagagggcctcagggagctgcaaaactcatccaggagaaaaaggcaggagcagcaagtgacccctcccaagctcccatctatggggcttagcaaaaaaagggaggaagtgggggctggatatgcccacccctgccaaaagccctgaccccagggaaggaggctgctcacccagccttggccctgcagggaatgttggggggcacagaggggagaagctctttcccccactccacattccttttgttgccaagatccttaattccctcctgcccatatccctacaggcgacggcagacagtgcaatggccctcctgccacttcagcacaccttgccccacctgggaccatcacacgtgaagcaccaggctgggagatgaggtgcacacagttgcagctaggtcggggccccagttaagctgtgccccaccaccctaggcaatgaggggcaggaaaggggtacagaatgaatggtgaaagagagtggagatacggaagggggagaggagaggagaaatgtggacagagggcttgaagacatggccgaataggctactgccacccggctttggggagatgggcgataagtgttgaggtaggctcgagaactgctccccaaatcagtgagaattgcattaggagccctctggggaaagagcacaggaactgagttgctgggcctcaaaacaaaaggctgcaggcacatggttagactgccgctgtctgaaggaccatatcttacagaaggtgcacatactcccaagggccactcttgccctggagatcttggccttggggccaaagacatttccatttccgatctccatggggaggagggacttaagcccaagtgggtcaggcctggcccaggtccttatactcccctatcttgtcctagcccaggcctccatgaaggagaacctggtggcattgccccagagctctccagagatgagcctcccctatccccaccctgtccccgtccccagcctaccaaagagtattcacacctttccatccctgactctatgggttactgtcccaattgcgaaacacccatactcctcttcaccctgtagcagggtcttctgctccagtcaccccggcctcttgcaagagaaagtccagggactggcaagaagaccctttgactaaagataatgtgctgtcatatcttggctgagaaactgttgagtcaggctagaggactggacaagagaagaggcattgagagcccccttgggagccattagccttgctctggtctgctgtgtggggttggggagtaggggggatcccacattgcctgggacatctgaatgctgatacgaatggacaggaaagggagccagagctgtatacctgggacaggccagggagcctttagtgccagcagggcctgtgtcctgggatgtgatgctagtgagtgaatgggagggcgggcctggagctgcgtgagagtgaaaccaagaagcggatggggaagggagagctggccttggtcagcttagggatgaatggagaaggaatcattcatgggcctcggctaggtcccagactgattacatgagactggggagtccttccctgccagttttctcatttattacagcctatcccccaaccctacccctgtgccctgcctacacactcccgtttggccctcagcactttgggcctggtcacataccccatccctagagtgctcttttcagctggggaggggaagaggtgctggctcctttccagacatgcttatgtataagtaaaggggcaggtgcttgggctccagagagaccctaggtactgccttctaactcctgcatcctcagaaggggaaaagggactgggaagtaaagggaaaccatatggccccagggaatggacccttggagactcccatcctctcttccccctcaccaagtgcccaggagacccctggctcagaccagcccaaggccttgcccagtggcaggggaaaggggcacctcactccacctcaaagtcatttgactgcccccatccaccccaccaccctaatcttccaccacctctccggctgcccctgccctccatcacagacagcagagccgggcagctttcttatgccattttctacactgtgcttcatgagtaggactttcttgcactagttcctatgactgagtctccaaactggtttcctagtagtcccccatcccttcctcccttacccagctatgattcagttgtctctgccctccctcttaccctgcctctgtgtttcggtgagagtctctgtatatgtactgctttctgttttgttgcattgtggggcagaggcctctctgctcttgtttaaccccataaagaaataaatggtaagacttgatgataa

SEQ ID NO: 31 - DNA, 2604 bp, Homo sapiens
aagcaccgcgcagccgcctccgccgcaggatcccccggtgcaggcctccgtgctggtgcggatcctggagctcagccgcgcgcgccctgcccgatcctgtgccgacccaccgcactatgcgcgccgtgccgctgcccgccccgctcctgccgctgctgctgctcgcgctcctggccgctcccgccgcccgcgccagcagagccgagtccgtctccgcgccgtggcccgaacccgagcgcgagtcgcggccaccgcccggcccggggcccgggaacaccacccggtttgggtctggggcggcgggcggcagcggcagctccagctccaacagcagtggcgacgccttggtgacccgcatttccatcctcctccgcgacctacccaccctcaaggcagccgtgatcgtggcgttcgcctttaccaccctcctcatcgcctgcctgctgctgcgcgtcttcaggtcgggaaagaggttaaagaagacacgcaagtatgatatcatcaccactccagcagagcgagtggaaatggcgccactaaatgaagaggatgatgaagatgaggactccacagtattcgacatcaaatacaggtaaaacctgtttcccagcctggtggcatcctgtggaaagttggtcagctgcaacctggggtgtgaaggactggacctggaagccctcttgcgtcggaggtgttgaaaccaaaacgaacgttatgtataaaaccccagctccatcgtgcgtgtcaggcatctgctcagactgtcactggcaagctcgtttccacgtcaccacaatggagttgcttctgccaccctttgggcatccctttaaagtgccccctacttctactccccatgtaagaggctttgtgccttgctaaggagcaaagggtagaaacatgttgattttaaagaagtttttttaagacaattgttgacaatagtaaaagagatcaggaggatcaagaatctaaaacaagcctgaaggatgtccaactgtgtatttagaatttccgacattcttctctactggatctacacattggaccccatctgatcctttgctgcttttttggcttggtcaggtcctggcctcattttggcgttacctgtgtcagagttcaaggtggatgtgcttagagctggtcagccccttccagacctggacacgtctgtggctccttttctttcttcctttttttttttttttaaaaaaaaaaaaggttcagcagaaatcagcgtggctagttcacaaagaatttccagtatcagggaaaaactgtgcgtgtgtgtgtgtgtgtgtgtgcacgtgtgtgcgtgtgcacgtgtgtgatacctataaaacagtttctccttctctgaagggaaaggaaagtgctaggcagcctgtgattagcaacattctttgtgcttttttgttgttcctctgctctgtcacagttctacgttgtttgccttagaaatgtaatttttaaaaaccattttaaaaatgaacggtgatttggctggctggaaaaaatcacactgtcaggggactatatttgaagtcagtctagacggggctggactaggaacccacctggacccaggagaccccacaggacccaggaggtccctgccggaaggcagaggttcaggtgagagtggctcacctctgagctggtgaagtgaggacttgcctgtgacatgacccagggatctgctgctggcttctggagacagggccttgggctgacttctcaggttgattgaggcctcctgactagcggtgttcccaggctagaggtgattggctgcaacaaagatgcttctattagtctattagcagtgccttcgggaccctgggattttgctctctctagaaaggtgttttttatttttttattttttatctcccccttttttcctggctttgctccagggtttgtgtatttgcctgtttattgtcctgctctttttttttttggatgaaaactccagcctttcctgactcacctccatcttcggttcttcagttttctgagaagagttgggatatgtgggaaggggcatgggagctcggcagcctccgcctgccaggaaggcagtttcgcctctgcaggaaagagcagagcccgtgggaagccctgggtgagggtggcgcagccggcccagcacgcatggtattgccagccacggggggcctgcgtgtagtctctgctccctgcatttcaccttctttgttgactttccttctctgttttcccccatctgtttgccagaggggtgggactggcaacagaacagccgtggctgctttatctctcctctccacggtgtactcaggcctgagtggtgactcacgggagcctggccacctcgcagctgttcgccccctcaacctttgaactggaactgctggctcacacagggttttcgacaactgcagctgaatctcatggaaaagctggattcctctgccttacgcagaaacacccgggctccatctgccaggtgcttgccactggtcctggcagaaatggcggctgctgaaagtgaccttccaaatccttggtggcacttcagcgccacaggctctccaataaaaaccctttacacacaaa

SEQ ID NO: 32 - DNA, 4301 bp, Homo sapiens
agtgcgcggtggcggcggcgtcgcgggcagctggcgccgcgcggtcctgctctgccggtcgcacggacgcaccggcgggccgccggccggagggacggggcgggagctgggcccgcggacagcgagccggagcgggagccgcgcgtagcgagccgggctccggcgctcgccagtctcccgagcggcgcccgcctcccgccggtgcccgcgccgggccgtggggggcagcatgcccgcgcgcgctgcctgaggacgccgcggcccccgcccccgccatgggcgcccctgcctgcgccctcgcgctctgcgtggccgtggccatcgtggccggcgcctcctcggagtccttggggacggagcagcgcgtcgtggggcgagcggcagaagtcccgggcccagagcccggccagcaggagcagttggtcttcggcagcggggatgctgtggagctgagctgtcccccgcccgggggtggtcccatggggcccactgtctgggtcaaggatggcacagggctggtgccctcggagcgtgtcctggtggggccccagcggctgcaggtgctgaatgcctcccacgaggactccggggcctacagctgccggcagcggctcacgcagcgcgtactgtgccacttcagtgtgcgggtgacagacgctccatcctcgggagatgacgaagacggggaggacgaggctgaggacacaggtgtggacacaggggccccttactggacacggcccgagcggatggacaagaagctgctggccgtgccggccgccaacaccgtccgcttccgctgcccagccgctggcaaccccactccctccatctcctggctgaagaacggcagggagttccgcggcgagcaccgcattggaggcatcaagctgcggcatcagcagtggagcctggtcatggaaagcgtggtgccctcggaccgcggcaactacacctgcgtcgtggagaacaagtttggcagcatccggcagacgtacacgctggacgtgctggagcgctccccgcaccggcccatcctgcaggcggggctgccggccaaccagacggcggtgctgggcagcgacgtggagttccactgcaaggtgtacagtgacgcacagccccacatccagtggctcaagcacgtggaggtgaatggcagcaaggtgggcccggacggcacaccctacgttaccgtgctcaagacggcgggcgctaacaccaccgacaaggagctagaggttctctccttgcacaacgtcacctttgaggacgccggggagtacacctgcctggcgggcaattctattgggttttctcatcactctgcgtggctggtggtgctgccagccgaggaggagctggtggaggctgacgaggcgggcagtgtgtatgcaggcatcctcagctacggggtgggcttcttcctgttcatcctggtggtggcggctgtgacgctctgccgcctgcgcagcccccccaagaaaggcctgggctcccccaccgtgcacaagatctcccgcttcccgctcaagcgacaggtgtccctggagtccaacgcgtccatgagctccaacacaccactggtgcgcatcgcaaggctgtcctcaggggagggccccacgctggccaatgtctccgagctcgagctgcctgccgaccccaaatgggagctgtctcgggcccggctgaccctgggcaagccccttggggagggctgcttcggccaggtggtcatggcggaggccatcggcattgacaaggaccgggccgccaagcctgtcaccgtagccgtgaagatgctgaaagacgatgccactgacaaggacctgtcggacctggtgtctgagatggagatgatgaagatgatcgggaaacacaaaaacatcatcaacctgctgggcgcctgcacgcagggcgggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaagtgcatccacagggacctggctgcccgcaatgtgctggtgaccgaggacaacgtgatgaagatcgcagacttcgggctggcccgggacgtgcacaacctcgactactacaagaagacgaccaacggccggctgcccgtgaagtggatggcgcctgaggccttgtttgaccgagtctacactcaccagagtgacgtctggtcctttggggtcctgctctgggagatcttcacgctggggggctccccgtaccccggcatccctgtggaggagctcttcaagctgctgaaggagggccaccgcatggacaagcccgccaactgcacacacgacctgtacatgatcatgcgggagtgctggcatgccgcgccctcccagaggcccaccttcaagcagctggtggaggacctggaccgtgtccttaccgtgacgtccaccgacgagtacctggacctgtcggcgcctttcgagcagtactccccgggtggccaggacacccccagctccagctcctcaggggacgactccgtgtttgcccacgacctgctgcccccggccccacccagcagtgggggctcgcggacgtgaagggccactggtccccaacaatgtgaggggtccctagcagcccaccctgctgctggtgcacagccactccccggcatgagactcagtgcagatggagagacagctacacagagctttggtctgtgtgtgtgtgtgtgcgtgtgtgtgtgtgtgtgtgcacatccgcgtgtgcctgtgtgcgtgcgcatcttgcctccaggtgcagaggtaccctgggtgtccccgctgctgtgcaacggtctcctgactggtgctgcagcaccgaggggcctttgttctggggggacccagtgcagaatgtaagtgggcccacccggtgggacccccgtggggcagggagctgggcccgacatggctccggcctctgcctttgcaccacgggacatcacagggtgggcctcggcccctcccacacccaaagctgagcctgcagggaagccccacatgtccagcaccttgtgcctggggtgttagtggcaccgcctccccacctccaggctttcccacttcccaccctgcccctcagagactgaaattacgggtacctgaagatgggagcctttaccttttatgcaaaaggtttattccggaaactagtgtacatttctataaatagatgctgtgtatatggtatatatacatatatatatataacatatatggaagaggaaaaggctggtacaacggaggcctgcgaccctgggggcacaggaggcaggcatggccctgggcggggcgtgggggggcgtggagggaggccccagggggtctcacccatgcaagcagaggaccagggccttttctggcaccgcagttttgttttaaaactggacctgtatatttgtaaagctatttatgggcccctggcactcttgttcccacaccccaacacttccagcatttagctggccacatggcggagagttttaatttttaacttattgacaaccgagaaggtttatcccgccgatagagggacggccaagaatgtacgtccagcctgccccggagctggaggatcccctccaagcctaaaaggttgttaatagttggaggtgattccagtgaagatattttatttcctttgtcctttttcaggagaattagatttctataggatttttctttaggagatttattttttggacttcaaagcaagctggtattttcatacaaattcttctaattgctgtgtgtcccaggcagggagacggtttccagggaggggccggccctgtgtgcaggttccgatgttattagatgttacaagtttatatatatctatatatataatttattgagtttttacaagatgtatttgttgtagacttaacacttcttacgcaatgcttctagagttttatagcctggactgctacctttcaaagcttggagggaagccgtgaattcagttggttcgttctgtactgttactgggccctgagtctgggcagctgtcccttgcttgcctgcagggccatggctcagggtggtctcttcttggggcccagtgcatggtggccagaggtgtcacccaaaccggcaggtgcgattttgttaacccagcgacgaactttccgaaaaataaagacacctggttgctaa

SEQ ID NO: 33 - DNA, 2637 bp, Homo sapiens
cctgcccagcaggggcggcggtcagaggcgggcagcaccccagttctccccgcacgccggcactcgcggctgctggagccccggctggctcaccccggggccgggcagaattgggctccaggtctctgacccctcccaaggatcatgccgcagccccactgacccaggagtaggggcctaagggcagggaacctggaatgggctgtgtgttctgcaagaaattggagccggtggccacggccaaggaggatgctggcctggaaggggacttcagaagctacggggcagcagaccactatgggcctgaccccactaaggcccggcctgcatcctcatttgcccacatccccaactacagcaacttctcctctcaggccatcaaccctggcttccttgatagtggcaccatcaggggtgtgtcagggattggggtgaccctgttcattgccctgtatgactatgaggctcgaactgaggatgacctcaccttcaccaagggcgagaagttccacatcctgaacaatactgaaggtgactggtgggaggctcggtctctcagctccggaaaaactggctgcattcccagcaactacgtggcccctgttgactcaatccaagctgaagagtggtactttggaaagattgggagaaaggatgcagagaggcagctgctttcaccaggcaacccccagggggcctttctcattcgggaaagcgagaccaccaaaggtgcctactccctgtccatccgggactgggatcagaccagaggcgatcatgtgaagcattacaagatccgcaaactggacatgggcggctactacatcaccacacgggttcagttcaactcggtgcaggagctggtgcagcactacatggaggtgaatgacgggctgtgcaacctgctcatcgcgccctgcaccatcatgaagccgcagacgctgggcctggccaaggacgcctgggagatcagccgcagctccatcacgctggagcgccggctgggcaccggctgcttcggggatgtgtggctgggcacgtggaacggcagcactaaggtggcggtgaagacgctgaagccgggcaccatgtccccgaaggccttcctggaggaggcgcaggtcatgaagctgctgcggcacgacaagctggtgcagctgtacgccgtggtgtcggaggagcccatctacatcgtgaccgagttcatgtgtcacggcagcttgctggattttctcaagaacccagagggccaggatttgaggctgccccaattggtggacatggcagcccaggtagctgagggcatggcctacatggaacgcatgaactacattcaccgcgacctgagggcagccaacatcctggttggggagcggctggcgtgcaagatcgcagactttggcttggcgcgtctcatcaaggacgatgagtacaacccctgccaaggttccaagttccccatcaagtggacagccccagaagctgccctctttggcagattcaccatcaagtcagacgtgtggtcctttgggatcctgctcactgagctcatcaccaagggccgaatcccctacccaggcatgaataaacgggaagtgttggaacaggtggagcagggctaccacatgccgtgccctccaggctgcccagcatccctgtacgaggccatggaacagacctggcgtctggacccggaggagaggcctaccttcgagtacctgcagtccttcctggaggactacttcacctccgctgaaccacagtaccagcccggggatcagacatagcctgtccgggcatcaaccctctctggcggtggccaccagtccttgccaatccccagagctgttcttccaaagcccccaggctggcttagaaccccatagagtcctagcatcaccgaggacgtggctgctctgacaccacctagggcaacctacttgttttacagatggggcaaaaggaggcccagagctgatctctcatccgctctggccccaagcactatttcttccttttccacttaggcccctacatgcctgtagcctttctcactccatccccacccaaagtgctcagaccttgtctagttatttataaaactgtatgtacctccctcacttctctcctatcactgctttcctactctccttttatctcactctagtccaggtgccaagaatttcccttctaccctctattctcttgtgtctgtaagttacaaagtcaggaaaagtcttggctggacccctttcctgctgggtggatgcagtggtccaggactggggtctgggcccaggtttgagggagaaggttgcagagcacttcccacctctctgaatagtgtgtatgtgttggtttattgattctgtaaataagtaaaatgacaatatgaatcctcaaaccatgaaatacccttgaaccttcctttgggagcgggggtggtcaatagggggtgaacggacagatatggctacaggcagcagcaggggaagctggagagggccctaatgcctaccaagcacggggcatccaaggtgtggagttttagaacacccagagtcccactgctcatctgcacgtgagtttagaagacaagcagctgaagatacattaaaatgtccccttcgttgctga

SEQ ID NO: 34 - DNA, 2784 bp, Homo sapiens
gtggagcgctgcggagggtgcgtgcgggccgcggcagccgaacaaaggagcaggggcgccgccgcagggacccgccacccacctcccggggccgcgcagcggcctctcgtctactgccaccatgaccgccaacggcacagccgaggcggtgcagatccagttcggcctcatcaactgcggcaacaagtacctgacggccgaggcgttcgggttcaaggtgaacgcgtccgccagcagcctgaagaagaagcagatctggacgctggagcagccccctgacgaggcgggcagcgcggccgtgtgcctgcgcagccacctgggccgctacctggcggcggacaaggacggcaacgtgacctgcgagcgcgaggtgcccggtcccgactgccgtttcctcatcgtggcgcacgacgacggtcgctggtcgctgcagtccgaggcgcaccggcgctacttcggcggcaccgaggaccgcctgtcctgcttcgcgcagacggtgtcccccgccgagaagtggagcgtgcacatcgccatgcaccctcaggtcaacatctacagcgtcacccgtaagcgctacgcgcacctgagcgcgcggccggccgacgagatcgccgtggaccgcgacgtgccctggggcgtcgactcgctcatcaccctcgccttccaggaccagcgctacagcgtgcagaccgccgaccaccgcttcctgcgccacgacgggcgcctggtggcgcgccccgagccggccactggctacacgctggagttccgctccggcaaggtggccttccgcgactgcgagggccgttacctggcgccgtcggggcccagcggcacgctcaaggcgggcaaggccaccaaggtgggcaaggacgagctctttgctctggagcagagctgcgcccaggtcgtgctgcaggcggccaacgagaggaacgtgtccacgcgccagggtatggacctgtctgccaatcaggacgaggagaccgaccaggagaccttccagctggagatcgaccgcgacaccaaaaagtgtgccttccgtacccacacgggcaagtactggacgctgacggccaccgggggcgtgcagtccaccgcctccagcaagaatgccagctgctactttgacatcgagtggcgtgaccggcgcatcacactgagggcgtccaatggcaagtttgtgacctccaagaagaatgggcagctggccgcctcggtggagacagcaggggactcagagctcttcctcatgaagctcatcaaccgccccatcatcgtgttccgcggggagcatggcttcatcggctgccgcaaggtcacgggcaccctggacgccaaccgctccagctatgacgtcttccagctggagttcaacgatggcgcctacaacatcaaagactccacaggcaaatactggacggtgggcagtgactccgcggtcaccagcagcggcgacactcctgtggacttcttcttcgagttctgcgactataacaaggtggccatcaaggtgggcgggcgctacctgaagggcgaccacgcaggcgtcctgaaggcctcggcggaaaccgtggaccccgcctcgctctgggagtactagggccggcccgtccttccccgcccctgcccacatggcggctcctgccaaccctccctgctaaccccttctccgccaggtgggctccagggcgggaggcaagcccccttgcctttcaaactggaaaccccagagaaaacggtgcccccacctgtcgcccctatggactccccactctcccctccgcccgggttccctactcccctcgggtcagcggctgcggcctggccctgggagggatttcagatgcccctgccctcttgtctgccacggggcgagtctggcacctctttcttctgacctcagacggctctgagccttatttctctggaagcggctaagggacggttgggggctgggagccctgggcgtgtagtgtaactggaatcttttgcctctcccagccacctcctcccagccccccaggagagctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtggtggcgggcgggtaggggtgtgggggccgtcttcctcctgtctctttcctttcaccctagcctgactggaagcagaaaatgaccaaatcagtattttttttaatgaaatattattgctggaggcgtcccaggcaagcctggctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctcccgggtggatgaagccaggcgtcgccccctccgggagccctggggtgagccgccggggcccccctgctgccagcctcccccgtccccaacatgcatctcactctgggtgtcttggtcttttattttttgtaagtgtcatttgtataactctaaacgcccatgatagtagcttcaaactggaaatagcgaaataaaataactcagtctgcagcccca

SEQ ID NO: 35 - DNA, 5657 bp, Homo sapiens
gaccaggcggcggcggctctgctgaggtgacaacgtgctagcagccctcgctcgctctgggcgcctcctcggcctcagcgtccgctctggccgcgctcgaggagcccttcagcccgccgctgcgctatgaaggcccctctctggggctggccgaggctggagccggctccctctgctcgcgggcaagtgtgaagagagaggcgcgggcgggagccggggctgcgcgcggcgctcgcgggccggcgcgggttccaggtgagcgcggactcggcgagccccgcactcggcgcggccggccggcgcctgctgggcttgatctgaggctgaatcccgtgtgtggaccgccgttccctcttcgcgggatcgttggccaggatagcagatgcatttttgtagaagcattttgaggatgaatgtttgcaaatcattttgaaattgccaagtgccacatacatggaatgtatcctgctttcatcttggagttcacctgtgtggcttggatttatcacagtagcatttgtcttcaatctgtgtgttaactagaaatcaaggaaagacatgaggagatttgtctactgcaaggtggttctagccacttcgctgatgtgggttcttgttgatgtcttcttactgctgtacttcagtgaatgtaacaaatgtgatgacaagaaggagagatctctgctgcctgcattgagggctgttatttcaagaaaccaagaagggccaggagaaatgggaaaagctgtgttgattcctaaagatgaccaggagaaaatgaaagagctgtttaaaatcaatcagtttaaccttatggccagtgatttgattgcccttaatagaagtctgccagatgtaagattagaaggatgtaagacaaaagtctaccctgatgaacttccaaacacaagtgtagtcattgtgtttcataatgaagcttggagcactctccttagaactgtttacagtgtgataaatcgttccccacactatctactctcagaggtcatcttggtagatgatgccagtgaaagagattttctcaagttgacattagagaattacgtgaaaaatttagaagtgccagtaaaaattattaggatggaagaacgctctgggttaatacgtgcccgtcttcgaggagcagctgcttcaaaagggcaggtcataacttttcttgatgcacactgtgaatgcacgttaggatggctggagcctttgctggcaagaataaaggaagacaggaaaacggttgtctgccctatcattgatgtgattagtgatgatacttttgaatatatggctgggtcagacatgacttatgggggttttaactggaaactgaatttccgctggtatcctgttccccaaagagaaatggacaggaggaaaggagacagaacattacctgtcaggacccctactatggctggtggcctattttctattgacagaaactactttgaagagataggaacttacgatgcaggaatggatatctggggtggagagaatcttgaaatgtcttttaggatttggcaatgtggaggctccttggagattgttacttgctcccatgttggtcatgtttttcggaaggcaactccatacacttttcctggtggcactggtcatgtcatcaacaagaacaacaggagactggcagaagtttggatggatgaatttaaagatttcttctacatcatatccccaggtgttgtcaaagtggattatggagatgtgtcagtcagaaaaacactaagagaaaatctgaagtgtaagcccttttcttggtacctagaaaacatctatccggactcccagatcccaagacgttattactcacttggtgagataagaaatgttgaaaccaatcagtgtttagacaacatgggccgcaaggaaaatgaaaaagtgggtatattcaactgtcatggtatgggaggaaatcaggtattttcttacactgctgacaaagaaatccgaaccgatgacttgtgcttggatgtttctagactcaatggacctgtaatcatgttaaaatgccaccatatgagaggaaatcagttatgggaatatgatgctgagagactcacgttgcgacatgttaacagtaaccaatgtctcgatgaaccttctgaagaagacaaaatggtgcctacaatgcaggactgtagtggaagcagatcccaacagtggctgctaaggaacatgaccttgggcacatgaagatcatgtcctccaagccatgaaagtgtctacgcttttgtttttccattatttcaattgggggaaaatattaactttgctgaattgaaagttttaaaaatccttttagtattctaaaacacaattgtttctaattcgtttctagaaatgtttgcttatttccctactaaaatttgtatctgatcaaagcacataagaatataaataatagcaaactactattaaacaacagaacaacttgtaaaacaaattgtgtttgctttaagaaaaatgtttattgcactcatgtcatagggttaattggaggttattttatttttggttgtcatggtgattgaaagagataatgtaaatgccttataaaatcttcattatgaaatattatcagttgctttataaactcactctttttatggatccttcatggaaacatgtttgatttctgtgtctacaacagggccacatattaaattacttctgaatggtgaattcatcttacaaaatgttccaagttttggacaaggaaaaacattacattggatattgaattcatggagcctttacagaagcatcacatttaaaccaatgtgaattcaaaaaagagaaggaaactttttaaattcaatttagagtacataaaaaaagaaatccgcgaagcattgaggggaacaagatgagtctaatccgcagcacttcgatcactgtgagagaactcaaagtgggttgcaatcattcctaacacaggctgaaactaaacaatcttgctcctagagtttatgttggatactcaattcttaaccaaaatcttggtctccacaaactctaccatcccttttctcttcactctatagacagtggcatgccattgatgctgtacagaattgcaggtgaaagggagaattttagacttaatttttaactctattgcacttaaagattttagttaggttaccactgtcattttcattttctatgttaaagaatacctttcagtgctgtgctccagtatctaaaaattttatcaccaggggaataaactcaatacacattcattaaacttttgttgtaattaaactgctatatattgtttgccatatattatggcccaaggaatatagttataatcaggctacattcacattttcttttctcatcttaaaaccctttatgttcaaaatacattagcagaggccatgaaagtgaaaaaaaatcagatttttgctagtaagtttttatatttgacatcattttaaatgctcaaagagttgccctatatatgcatgttatccattataaatgcactcagcagctaagagaaatttgagaggaaaagtggaagaagtgttttctggagcagaagattccacttctttggtcctcatctttacttaaaaagctcttatagaaaggattaatcattttgactgcatacaaactatgtctctgacatgcacatacactgctttataatgaaaatgaggacactttctgatggtcagtaaaatcttaaatgatttttgccactggtattccttcctcttttgactttttattggtacaactgtagggaagaatctacaacctggagcatttcaggtttgctctttaaatatagacacccctcaccatgagctctctgtgaatccgtgaatttcctaaaattgtaagcaaaatgttgaatatcagggcatttttttttctgaggtgggagtatgtcactcacagcaaacttggaaagaaggctatgactcccaagaggcagtgaaccattgccttaaattaatagcagcctctcaagtccattgaggcctcatgtaaaattcccatttttcatctttacactccttttctcccctcatttcctcttctccttactaaggtaaaaagaccctgcacagcattattacttaagttgaaaaagcttcaactctcaaggactcatgtataccatatgttccacttattgctttgttagtcaaaatgcatgttatgtagaaaatggtcaatggcaaatttttataaatacagctaccccatcaaagctgaacttgaaacgttttagcagaattttaaatatgtgaaagttcattgtggtcatggtgagaaaactaaaactacatgagtttcatgttagaaaagaatttttaaacaatcttcagatggcttgaacacgtgccattatagtatctaacaaaaagtggcataaaatattacaaaacatccaacactagaaagcaatgactaacatttaatttgtttacaaaaatgtttattgtcttcagtacaaaaagttaaaaccatgattggattcataatgcacttgtcttatcccttatttatggagctagactgacatatttcaaaccaatctcttctgtggtcttctccatctcagttaatgcaacttcaaccttccagatgctcaggtcaaaaactgaaagttgcttttgactcctctatttctgtttcaactctcgtctaatccaacagcaaatccccttgatgctacctttgaaatataactagaaaagaatgacttgccaccatatccactaggtgtcactacctctaacctttttaatcgcaatatgcttattatttagttccctaatttcccagtccttgtcttgaacaatcttttctcagtacaacagccatagtgattctgttaaccatgaatttgattgtgtcacttccctgctcacaatcttccaatgacttctccctccggtggccttcaaggtcctttatgagtgttacccctctacacgtccacaccactcaccacacatacatacacatgcacacacacacacatgcaattctacctttttctaacaccatctcttatctctcattattctgcctcttacttaccctattatggctcccaagaaagttcctgctttagtgttttgttccctctgccccagagagctccccttagtgatctcagttcaaatattatcttatcagtaagacaaacccttctcccatctgccttccctatcccctgtacctgacaatctatgagtttgcttctttatttctgtctatacttccccctccccagccccaaacatgcccatcacatgccctagaaggtaagtcccatgaaggcaggggctttgtcagttttgttcatttggtatttctggcatatatattctctaaatatttcttgaattaatgaactgaaaaatgtgtgttaaagttgctaagtgtaactgtatcatactttttttgtattttaaattttaaaataaaggctaatatatttagacaggatttccaaaaactttgtcttcaaattttaattttcttcctaatattcttcacattaaactatggactctaattttctggataaaatatcctgccttatggaaatgaaatatgaaattttattaaaatgctgctatattaca

SEQ ID NO: 36 - DNA, 1285 bp, Homo sapiens
gctctctgctcctcctgttcgacagtcagccgcatcttcttttgcgtcgccagccgagccacatcgctcagacaccatggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggcaccgtcaaggctgagaacgggaagcttgtcatcaatggaaatcccatcaccatcttccaggagcgagatccctccaaaatcaagtggggcgatgctggcgctgagtacgtcgtggagtccactggcgtcttcaccaccatggagaaggctggggctcatttgcaggggggagccaaaagggtcatcatctctgccccctctgctgatgcccccatgttcgtcatgggtgtgaaccatgagaagtatgacaacagcctcaagatcatcagcaatgcctcctgcaccaccaactgcttagcacccctggccaaggtcatccatgacaactttggtatcgtggaaggactcatgaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaaacctgccaaatatgatgacatcaagaaggtggtgaagcaggcgtcggagggccccctcaagggcatcctgggctacactgagcaccaggtggtctcctctgacttcaacagcgacacccactcctccacctttgacgctggggctggcattgccctcaacgaccactttgtcaagctcatttcctggtatgacaacgaatttggctacagcaacagggtggtggacctcatggcccacatggcctccaaggagtaagacccctggaccaccagccccagcaagagcacaagaggaagagagagaccctcactgctggggagtccctgccacactcagtcccccaccacactgaatctcccctcctcacagttgccatgtagaccccttgaagaggggaggggcctagggagccgcaccttgtcatgtaccatcaataaagtaccctgtgctcaacca

SEQ ID NO: 37 - DNA, 3712 bp, Homo sapiens
gcactccgagtccgcccgaggagccgggccccggccgctgtccagccgctccgtgccccgcgcgtcctgcgccgccgccaccgcctcctggggagacgcagccacttgcccgccatggatactcccagggtcctgctctcggccgtcttcctcatcagttttctgtgggatttgcccggtttccagcaggcttccatctcatcctcctcgtcgtccgccgagctgggttccaccaagggcatgcgaagccgcaaggaaggcaagatgcagcgggcgccgcgcgacagtgacgcgggccgggagggccaggaaccacagccgcggcctcaggacgaaccccgggctcagcagccccgggcgcaggagccgccaggcaggggtccgcgcgtggtgccccacgagtacatgctgtcaatctacaggacttactccatcgctgagaagctgggcatcaatgccagctttttccagtcttccaagtcggctaatacgatcaccagctttgtagacaggggactagacgatctctcgcacactcctctccggagacagaagtatttgtttgatgtgtccatgctctcagacaaagaagagctggtgggcgcggagctgcggctctttcgccaggcgccctcagcgccctgggggccaccagccgggccgctccacgtgcagctcttcccttgcctttcgcccctactgctggacgcgcggaccctggacccgcagggggcgccgccggccggctgggaagtcttcgacgtgtggcagggcctgcgccaccagccctggaagcagctgtgcttggagctgcgggccgcatggggcgagctggacgccggggaggccgaggcgcgcgcgcggggaccccagcaaccgccgcccccggacctgcggagtctgggcttcggccggagggtgcggcctccccaggagcgggccctgctggtggtattcaccagatcccagcgcaagaacctgttcgcagagatgcgcgagcagctgggctcggccgaggctgcgggcccgggcgcgggcgccgaggggtcgtggccgccgccgtcgggcgccccggatgccaggccttggctgccctcgcccggccgccggcggcggcgcacggccttcgccagtcgccatggcaagcggcacggcaagaagtccaggctacgctgcagcaagaagcccctgcacgtgaacttcaaggagctgggctgggacgactggattatcgcgcccctggagtacgaggcctatcactgcgagggtgtatgcgacttcccgctgcgctcgcacctggagcccaccaaccacgccatcatccagacgctgatgaactccatggaccccggctccaccccgcccagctgctgcgtgcccaccaaattgactcccatcagcattctatacatcgacgcgggcaataatgtggtctacaagcagtacgaggacatggtggtggagtcgtgcggctgcaggtagcggtgcctttcccgccgccttggcccggaaccaaggtgggccaaggtccgccttgcaggggaggcctggctgcagagaggcggaggaggaagctggcgctgggggaggctgagggtgagggaacagcctggatgtgagagccggtgggagagaagggagcgcagccttcccagtaacttctacctgccagcccagagggaaatatggattttcacaccttgcctggccaccctggaaaaacaagccaaggaggatttcttttgttctgttttctctctctctctctctctctctctctctctctctctctctctctctattactgtggctttggatttccttatgtgtcttacaggctttgatagaaggggaggggaggagagatgcatacccgtttctcaactgctccatggattgaaaaaataacagtttaaaaagggaaacaatgtgggaggaagaatcaccgttgacgcatcttgatttggttggtttttacatgtgtaaagaaggtggggtctctggccatgtcatagcccatgtcttgtgccctcccacacagaaagtgttagatagggaaattggcaaaaagaatagttaagtcaggaatggtcctgcctatagaagagctttgagagaggtgggcccacgggtgcccctctcacccatttgtgtactctgtgagtttaccagctctgccctggcctctttcggtaccaggaactggcaaccttcatctcactcctgagggcccaggtctctgccttcattgttgctttttctggtgggggcaaggggagctggtatggatggaatgacaagaattagtccaaatggaaccccttgaaggataatgagaaaccacaaggcctgcctctgactggggctgacacggaggtgcattagcccaggctggaggtagcccacccaaatgccctttctgattctaattgatttctttcaacagaatttgccaaaattcagacatgcacttctaaggggaaggtgattttccagttcaaaaaaatgggcaggagtggggaacaaaacaattaacgtaagagctacaaaggagggaaaaggaaccaagaagtagaaggagtcccatcaggagggaagatggtgggcctcagggaggatggggatcaagggacaggccaggagccaggagtggggaagggagggatgaaaggggacacaagtccctgtctctgaagtttctttaaaatctgagttccctcccctctctttgacattcctgaaagattaccagccagcaatagcccagggctcccccaaaagaattggttcagattgtaattatcagttaggcaatgtttttaaaacttagtaatgagaaactgtgaaaagagccaagtgttacattgagcttggggtgggagatggggaacaggcagtgaggaaggagacaggggtggaattcgtcttctgggaggaagctggagagagcacagtgaaattgaaatacccattcccagatagtcaaaaacatgaactttcccccagcctgcaccagtattgttttcaaacattgcccatgagtaggccctttgaagagttagcttcctcctcatctttgactataaaattgtttaatcaatggaatttgtaccagccttttaaaaagttttagtttttcctaagtgattttgctctcttccaatctaaacctgttgcttgtttggttcagagaactacaaactgtcaaagaaagggtggggatgataagaaatgctaatataaaaatgctaagtgaaaaaaagacttggccaggagaaataatttaaaatgcacatttgctttggatgcactgttgttctgttaaggctgtatatatttgtttatttaaggtgactgaaagtgcaaagaggaaatggacagcatgcaattcatcctaatgtacaaaacgttatatgcactcaaatgttataatttctaatatttttaaagtttatattcgagttgtacaaagttaagcattaatcagatatttcattttttcataatgttaccattttcttaaatattattacaaaattttaagtctgtctaatggagagttttttttaaactgtctacctcatataatacaagtatttacaacgctaaagttaccagaggtcaatgaataatcaaaacattttttacagtacacctttcctggatgatatgcaatcgaatgctatattattaaacgcatttttctccttaa

SEQ ID NO: 38 - DNA, 1921 bp, Homo sapiens
ggtctggagtttgcggagggccgagccgggtgcgcacggggaggcggaggcagcggcggcggcggcggcggcggcggcggcggcggagcagatgaagaaactgaggccctgtgatgtgaagtgacttgccccccagccacacagctggaccattctggctgctgtctggacaagaagtcgtagggggtgagggtggaagctgggaaacccacaggaggcaaccacactagtttagatcttctggtgaccccacttctcgctgctcatgccgctgggactggggcggcggaaaaaggcgccccctctagtggaaaatgaggaggctgagccaggccgtggagggctgggcgtgggggagccagggcctctgggcggaggtgggtcggggggcccccaaatgggcttgcccccccctcccccagccctgcggccccgcctcgtgttccacacccagctggcccatggcagtcccactggccgcatcgagggcttcaccaacgtcaaggagctgtatggcaagatcgccgaggccttccgcctgccaactgccgaggtgatgttctgcaccctgaacacccacaaagtggacatggacaagctcctggggggccagatcgggctggaggacttcatcttcgcccacgtgaaggggcagcgcaaggaggtggaggtgttcaagtcggaggatgcactcgggctcaccatcacggacaacggggctggctacgccttcatcaagcgcatcaaggagggcagcgtgatcgaccacatccacctcatcagcgtgggcgacatgatcgaggccattaacgggcagagcctgctgggctgccggcactacgaggtggcccggctgctcaaggagctgccccgaggccgtaccttcacgctgaagctcacggagcctcgcaaggccttcgacatgatcagccagcgttcagcgggtggccgccctggctctggcccacaactgggcactggccgagggaccctgcggctccgatcccggggccccgccacggtggaggatctgccctctgcctttgaagagaaggccattgagaaggtggatgacctgctggagagttacatgggtatcagggacacggagctggcggccaccatggtggagctgggaaaggacaaaaggaacccggatgagctggccgaggccctggacgaacggctgggtgactttgccttccctgacgagttcgtctttgacgtctggggcgccattggggacgccaaggtcggccgctactaggactgcccccggaccctgcgatgatgacccgggcgcaacctggtgggggcccccagcagggacactgacgtcaggacccgagcctccagcctgagcctagctcagcagcccaaggacgatggtgaggggaggtggggccaggccccctgccccgctccaatcggtaccatcccctccctggttcccagtctggccggggtccccggcccccctgtgccctgttccccacctacctcagctgggtcaggcacagggaggggagggatcagccaaattgggcggccacccccgcctccaccactttccaccatcagctgccaaactggtccctctgtctccctggggccttgggttctgtttgggggtcatgaccttcctagtttcctgacgcagggaatacaggggagagggttgtccttccccccagcaaatgcaataatgccctcacccctcctgagaggagccccctccctgtggagcctgttacctccgcatttgacacgagtctgctgtgaaccccgcaacctcctccccacctcccatctctccttccaggcccatccctggcccagagcaggagggagggagggacgatggcggtgggtttttgtatctgaatttgctgtcttgaacataaagaatctatctgctgtt

SEQ ID NO: 39 - DNA, 3310 bp, Homo sapiens
agagccgagacaaggcagttggaggcagcggtggcaggggctgcaggagcaagtgaccaggagcaggactggggacaggcctgatcgcccctgcacgaaccagacccttcgccgccctcacgatgactacctctccgatcctgcagctgctgctgcggctctcactgtgcgggctgctgctccagagggcggagacaggctctaaggggcagacggcgggggagctgtaccagcgctgggaacggtaccgcagggagtgccaggagaccttggcagccgcggaaccgccttcaggcctcgcctgtaacgggtccttcgatatgtacgtctgctgggactatgctgcacccaatgccactgcccgtgcgtcctgcccctggtacctgccctggcaccaccatgtggctgcaggtttcgtcctccgccagtgtggcagtgatggccaatggggactttggagagaccatacacaatgtgagaacccagagaagaatgaggcctttctggaccaaaggctcatcttggagcggttgcaggtcatgtacactgtcggctactccctgtctctcgccacactgctgctagccctgctcatcttgagtttgttcaggcggctacattgcactagaaactatatccacatcaacctgttcacgtctttcatgctgcgagctgcggccattctcagccgagaccgtctgctacctcgacctggcccctaccttggggaccaggcccttgcgctgtggaaccaggccctcgctgcctgccgcacggcccagatcgtgacccagtactgcgtgggtgccaactacacgtggctgctggtggagggcgtctacctgcacagtctcctggtgctcgtgggaggctccgaggagggccacttccgctactacctgctcctcggctggggggcccccgcgcttttcgtcattccctgggtgatcgtcaggtacctgtacgagaacacgcagtgctgggagcgcaacgaagtcaaggccatttggtggattatacggacccccatcctcatgaccatcttgattaatttcctcatttttatccgcattcttggcattctcctgtccaagctgaggacacggcaaatgcgctgccgggattaccggctgaggctggctcgctccacgctgacgctggtgcccctgctgggtgtccacgaggtggtgtttgctcccgtgacagaggaacaggcccggggcgccctgcgcttcgccaagctcggctttgagatcttcctcagctccttccagggcttcctggtcagcgtcctctactgcttcatcaacaaggaggtgcagtcggagatccgccgtggctggcaccactgccgcctgcgccgcagcctgggcgaggagcaacgccagctcccggagcgcgccttccgggccctgccctccggctccggcccgggcgaggtccccaccagccgcggcttgtcctcggggaccctcccagggcctgggaatgaggccagccgggagttggaaagttactgctagggggcgggatccccgtgtctgttcagttagcatggatttattgagtgccaactgcgtgccaggcccagtacggaggacgctggggaaatggtgaaggaaacagaaaaaaggtccctgcccttctggagatgacaactgagtggggaaaacagaccgtgaacacaaaacatcaagttccacacacgctatggaatggttatgaagggaagcgagaagggggcctagggtggtctgggaggcgtctccaaggaggtgacacttaagccatccccgaaagaggtgaaagagatcactttggggagagctggagaacaggattctaggcggaagcgatagcataggcaaaggcccttgggcaggaaggcgctcagccttggctggagtagaattaagtcagagccaacaggtggggagagacagagaagtgggcaggggcacccaagttgggatttcatttcaggtgcattggagattcttaggagtgtctcttgggggtaatattttattttttaaaaaatgaggatgtcactcttacccaggttggtcttgaactcctgggctcaagcaatcctcccaccacgggtctctcaaagtgctgggattacaggcgtgagccaccgcacccggcttttttttttttttttaaacggagtctcactctgtcacccaggctggagtgcagtggtgcaatttcagctcactgcaccctccacctcccgagttcaagcctcccgggtagctgggattacaggcaccgccaccatgcctggctaatttttgcattttcagtagagatagggtttctccatgttggccaggctggtctcgaactcctgacctcaagtgatccacccacctcagcctcccaaagtgctgggattacaggcataagccaccatgcccggcccaaatgggctaatgttttaaacagatccttcttgtctgccctgtaggaggacaaattatcaggggcaggggtggaagctggagcccagaaaggaggggactgcaggtgggaagtgatggtggctggaccaggatggaggccactgaggggtatgaagcagtcggatttgaagctgtttaaaaggtggaggtgagaggatttcatgaaggagcacatgaggacacagcagcagagaggactccttggctttggatggtggagagactaaagatagagagattgggttcgggtagggggagaaccacgtgtgctctttggaaaggttaggctggcagtgtttgtaggacatgacaggacactgagtgtaagggtctggagctctcaggagaggggcgagctggagatagtaatgtgagaggcactgggtcctgagagggtgatttggtgtggaccggagcacaggtgaggcaaggcaggcctcgcagctgaaactttatatccagagcagccagggccactgctggctgcggagtgaggacgcatatccccactgtccttagatgggtggcccctggaacctgggagaatgagggggcatgctgacagtctcattgtggctggaccacctgtacatacacccacaagaccctcacccctaaatcctccccctacacatatgcacacttaagttaccgtatgggtgttgtcgagcattttccctggggtctgtggctccctggaccgacatgccccaaagctgaactcagccttttcaagcttgcggccctgctgcccaattcccctacaccctgccttgtgggttctcgcggggtgggggccttagggcaaggctcttgtaaataaagtataagaaacagtt

SEQ ID NO: 40 - DNA, 753 bp, Homo sapiens
atgcttgcctactcctctgtccactgctttcgtgaagacaagatgaagttcacaattgtctttgctggacttcttggagtctttctagctcctgccctagctaactataatatcaacgtcaatgatgacaacaacaatgctggaagtgggcagcagtcagtgagtgtcaacaatgaacacaatgtggccaatgttgacaataacaacggatgggactcctggaattccatctgggattatggaaatggctttgctgcaaccagactctttcaaaagaagacatgcattgtgcacaaaatgaacaaggaagtcatgccctccattcaatcccttgatgcactggtcaaggaaaagaagcttcagggtaagggaccaggaggaccacctcccaagggcctgatgtactcagtcaacccaaacaaagtcgatgacctgagcaagttcggaaaaaacattgcaaacatgtgtcgtgggattccaacatacatggctgaggagatgcaagaggcaagcctgtttttttactcaggaacgtgctacacgaccagtgtactatggattgtggacatttccttctgtggagacacggtggagaactaaacaattttttaaagccactatggatttagtcatctgaatatgctgtgcagaaaaaatatgggctccagtggtttttaccatgtcattctgaaatttttctctactagttatgtttgatttctttaagtttcaataaaatcatttagcattgaa

SEQ ID NO: 41 - DNA, 1516 bp, Homo sapiens
tgacaagatggcggcaggaggcagtggcgttggtgggaagcgcagctcgaaaagcgatgccgattctggtttcctggggctgcggcccacttcggtggacccagcgctgaggcgaaggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgaaaaaaaaaaaaaaaaaaaa

SEQ ID NO: 42 - DNA, 2273 bp, Homo sapiens
agaaggaggaagaagggccctgctggtcacacaggacccagtctgcggtgggggttttcccgccaccgccccgccctccctggggcccccacctcaccctctcctggcacccttcaccgtcaacctgtcgggccgggtctgagcaggtctggaggtgggcggggagccctggcctccccacctcctcccgtccccaccctgttcccagcactcaagccttgccaccgccgagccgggcttcctgggtgtttcaggcaaggaagtctaggtccctggggggtgacccccaaggaaaaggcagcctccctgcgcacccggttgcccggagccctctccagggccggctgggctgggggttgccctggccagcaggggcccgggggcgatgccacccggtgccgactgaggccaccgcaccatggcccgctcgctgacctggcgctgctgcccctggtgcctgacggaggatgagaaggccgccgcccgggtggaccaggagatcaacaggatcctcttggagcagaagaagcaggaccgcggggagctgaagctgctgcttttgggcccaggcgagagcgggaagagcaccttcatcaagcagatgcggatcatccacggcgccggctactcggaggaggagcgcaagggcttccggcccctggtctaccagaacatcttcgtgtccatgcgggccatgatcgaggccatggagcggctgcagattccattcagcaggcccgagagcaagcaccacgctagcctggtcatgagccaggacccctataaagtgaccacgtttgagaagcgctacgctgcggccatgcagtggctgtggagggatgccggcatccgggcctgctatgagcgtcggcgggaattccacctgctcgattcagccgtgtactacctgtcccacctggagcgcatcaccgaggagggctacgtccccacagctcaggacgtgctccgcagccgcatgcccaccactggcatcaacgagtactgcttctccgtgcagaaaaccaacctgcggatcgtggacgtcgggggccagaagtcagagcgtaagaaatggatccattgtttcgagaacgtgatcgccctcatctacctggcctcactgagtgaatacgaccagtgcctggaggagaacaaccaggagaaccgcatgaaggagagcctcgcattgtttgggactatcctggaactaccctggttcaaaagcacatccgtcatcctctttctcaacaaaaccgacatcctggaggagaaaatccccacctcccacctggctacctatttccccagtttccagggccctaagcaggatgctgaggcagccaagaggttcatcctggacatgtacacgaggatgtacaccgggtgcgtggacggccccgagggcagcaagaagggcgcacgatcccgacgcctcttcagccactacacatgtgccacagacacacagaacatccgcaaggtcttcaaggacgtgcgggactcggtgctcgcccgctacctggacgagatcaacctgctgtgacccaggccccacctggggcaggcggcaccggcgggcgggtgggaggtgggagtggctgcagggacccctagtgtccctggtctatctctccagcctcggcccacacgcaagggagtcgggggacggacggcccgctgctggccgctctcttctctgcctctcaccaggacagccgccccccagggtactcctgcccttgcttgactcagtttccctcctttgaaagggaaggagcaaaacggccatttgggatgccagggtggatgaaaaggtgaagaaatcaggggattgaggacttgggtgggtgggcatctctcaggagccccatctccgggcgtgtcacctcctgggcagggttctgggaccctctgtgggtgacgcacaccctgggatggggctagtagagccttcaggcgccttcgggcgtggactctggcgcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatccccccatcccttgcaggctgggggctgggcatgctgcatcttaaccttttgtatttattccctcaccttctgcagggctccgtgcgggctgaaattaaagatttcttagaggctg

SEQ ID NO: 43 - DNA, 954 bp, Homo sapiens
atgactgagcagatgacccttcgtggcaccctcaagggccacaacggctgggtaacccagatcgctactaccccgcagttcccggacatgatcctctccgcctctcgagataagaccatcatcatgtggaaactgaccagggatgagaccaactatggaattccacagcgtgctctgcggggtcactcccactttgttagtgatgtggttatctcctcagatggccagtttgccctctcaggctcctgggatggaaccctgcgcctctgggatctcacaacgggcaccaccacgaggcgatttgtgggccataccaaggatgtgctgagtgtggccttctcctctgacaaccggcagattgtctctggatctcgagataaaaccatcaagctatggaataccctgggtgtgtgcaaatacactgtccaggatgagagccactcagagtgggtgtcttgtgtccgcttctcgcccaacagcagcaaccctatcatcgtctcctgtggctgggacaagctggtcaaggtatggaacctggctaactgcaagctgaagaccaaccacattggccacacaggctatctgaacacggtgactgtctctccagatggatccctctgtgcttctggaggcaaggatggccaggccatgttatgggatctcaacgaaggcaaacacctttacacgctagatggtggggacatcatcaacgccctgtgcttcagccctaaccgctactggctgtgtgctgccacaggccccagcatcaagatctgggatttagagggaaagatcattgtagatgaactgaagcaagaagttatcagtaccagcagcaaggcagaaccaccccagtgcacctccctggcctggtctgctgatggccagactctgtttgctggctacacggacaacctggtgcgagtgtggcaggtgaccattggcacacgttaa

SEQ ID NO: 44 - DNA, 6843 bp, Homo sapiens
ggggcggtagccgagcctgtggcccgggcggggctcctctccggcggcgccggagtctgggggccgcggcttccccctcccggccagcggcggctcctggcccctcctcccccggccgcccccatccccgccgccgccgccgccaaagctaaacccggccgttgcctgcaggagccgcggcagcgggcgatcgggccgtgaggagcctcgggcgcggcctcgcctcccgggcccggcgcctgcctcagcacagcggacagcgccgcgccccttgcctggacccagccgcccgcccgcccccggcccacctgagcccgggcccgcggcgcccgcatcagcactgcggacagcgccccgggccccagctcgccgccaccgccgccgcccacctgctcccggggtcagcaccgcggagacccccctcgcccggccccgcgacagcctccgagcgcccccggatcatggccaccgaggtccacaatctgcaggagctccggcgaagtgcctcactggccaccaaggtctttatccagagagactacagcgatgggaccatctgtcagttccagaccaaattccccccagagctggacagccggatcgagcggcagctctttgaagagactgtgaagaccctcaacggattttacgcagaggctgagaagattgggggcagctcctacctcgagggctgcctggcctgcgccacggcctacttcatcttcctctgcatggagacccactatgagaaggttctcaagaagatttcccgctacatccaggagcagaatgagaagatctttgcacctcgaggcctcctacttacagaccctgtggagcgtgggatgagggttattgagatctccatctacgaggaccggtgcagcagtggcagctccagcagcggcagcagcagcggcagtggcagcagcagcggtgggggtggtggggcgggggcccggtgactggccgagagtccctgtagggaggtgtatggccggagtgagggccttgcagacctgcggcggctgcgctaccagagcacccgcttctgagtcattctttgggctcaccctgctgcccggggtgggagggagggtgacgggcctcatatttcctgtgggccatcaacctatgccccctgtccctcacccccgtctggatcagtccatttcctgacctgggggcttttccttcccgatggggctggtctgggccacacagagacagatcttcctaggaaggctggggtggggagaacacaacctaggcggcccctctcttccacagcccctctcccaaccctgcgaggggggccgaggcctgccacatagaggactcccacactgcatgacccctcatcccaaacccatatccaccaggactctttcccttgggccctgcgtcccgtggctgtctcccagtatctgttccttctcatgcccctgcagggccccggcctgtctatgatcctgcctccaccaaattcaaggtgtggggagacgggtgccgtggttgggagctgttcagcgcactcctgacctcttctagacctatggctttcctgtcctgcattcagagctagaggccagctcggccttgcgagaagcatccaactttgagactttgcaggctgccaggtgctggttggggggcacagagcctggggctctgggaggtaatatgggggtctgggaaactccgtgaagagacatagccatgcggggcctgaatctcctgaactacagccagtttcctgagattagaacctgtgtgtatgcacatgtgaatgtatgtgtgagtgcacatgtgtgtaagtgcagtgtgcgtaaatgtgtgagtctgcgtgtgttagcatgcctgtatgtgagcgcgtgtgtgagcgcatgtgtgtgcaccagtgcacaagtgtatgaatgtggacacatttataagcacacctgtgtgtgtctgagtacatgtgcacacacgtgtgcacaaatgtgcatttatatgagtgtgagtgcatgcatgtgcatgaacatgtgtgcacaagcatgtgtgtatgagtgttcatgtgtatgagtgtgtgtgtatgcaggtgagtgcatgtgtgtgtgagtgtgtttgtgtgttccccttggctgccaggccaacgactgcttctctgcatcctgctgtcttcgctacctgagggtctgtgacttcttccctgtgtgggtccagcctgaccccctgtaagtaaatgtccaaaagccccttgcccctcccctagggctaccagggaacatactctactgcatatgttctagtggaagagaagccggggttctaggaaagaagagccaaactttggtggcctttggtgccccctctcagctccccatgacaagacaacggggctgcagacactgtgtgttcagcctgcccaggggctggggctctttaaggctttgtaggtgaggtttccatggaccttcaaaggtgccagcagcctgcaggggaaaggcaaactccctccttgcaaggaaaggagatgtccagccaatgatgcccggcttctgaggcccagaggagcaggtgggatgggagcagcccctggggctggtgtcccgaagatgaaatgaagggggctgcctatctcagttggcgggaggtgttagaagtggatgtgcaagaccagccactggaggtagctctctggagtcaaagagaggcctgcttttctaccagacatgggagcagcatgtaggatacaagggcctacccagagaccagagagagtcagcctagtccttgcagcctcaggaagtcctcggcccaagtgagtcctggtccaaggatccccctggagagccgcagttcagtgggctccaccgcagcccctggccacggcctatgccctccctgggcccctgtggggctgggcattgtgtctgacctgtgcatctcccatgggagggctgggcacaggcagtgctatggccttttttttttttttctttttccaataaaagaacttgcccagcgtgaagctctgtgatgctttctctgccccgtgacgatggagggtcagttctatgctccaggaccacatgaggggatactcagctgcctgaactggacctgacatggggagcaggatgaactctgtcttcttggagcttgcagtctactgaagaggcagacacctcagcatctctaatctggaatctttggggcacttgtagccttgggtgggggaacaggttggactgaaagcgaggccaaaagtaatcaattaatgatatcaataaatcctcatttcttgagctcttcccctgggttgggtcctgttgggagctggatcacacaggtcactcagtactgaagatgagaaagtagctggatgatcacttctcggccttttggccaagatcaaatatggagaaagtagctggatgttggaacctagcagagttgtgtcttgaattttataatttattgagcacctactatgtgccagatactttgctgaaaccatatgttagagctggcaggggatttaaagatcacttgaatcctgtcacagaggtccagagagggtgggtgacttgccctaggccacacagctggttgatgataacagggcccaagcttggaacccaggtctcctgactcagtgcccactctgttaccacagggatggcacccagatgggaagctgcctgaggctgcagggaggctgggatcacaaactcaggcctgttcccagagaggggctcatcagactgtggggacaacggctccagcctcttaggtgggggctgggcagtcccctctgggtggttctcatgtttgttgtcactgccgctaagggctgcagtgagctgtgtgcagcctggactcactccctctgctggaacctgggccgtgtgtgggttgccacaagtgagcgtgttctctaatatgagggcaggttcattctgttttgggataggaagtttgttctaccccgaggccagatttgaatccaaactcagctcttctagagatgaggtcctggggagggggtgaggatttactaaacgggtaaaaccaaatctgggtgcttatctgactgagaggcattcaacccttccattttcaaatggtaatcataataataatagtagctgacgtttatttagcacttcctatgtgccaggcactaggctaagactctacataattagtcattcaattctcacagcaaccctctatggcatggattcttatttcccattttacatatggggaaactgaggctcatggacgttaagtaactgggaaattgcagatcttggctttgaatctaggcaatctgactccaaactgcaaggaagaagacagatccagcctcagaggccgcttaacagcttgagggcctcagccgtcctgggattaggatcaggcagattcccagggaaggacttggagccatgcctgggttttgaggccgggctggcacctccacttccagggcatcacgggagggtgcatgggctgtgctcgcaggcatgcgggacccagaggcagcccggtgaagggtagtgggggactcgactcactgtgggcctggggaggtgtggtttctctctgctggcttagttacaggtggtggcctgtctctccggggtctggctgtagccatgtccctgcacccaccttgccagccagggacaggccccatcaagacccaggagcagctccagcctcagccagactgtccccgaggtcccaagtgaggccccagccactcaggcatgcctcaggaagctcctgctgcacatgctcctctccctgcgccagcaccctgctgtctggcttccttcctttggccacagggcgggtgtgtgtgaaaccacagggtttacagaagctcgaggtgccactgagtggcaggattatgcactgcactcggggaatcaaaggtggagacagaaagaactatggctgttgtgacacgtcccccacggctccccggttggcagccactgccacccgcagggacttttctgtggcttccagaggtgtggggcaaaggtggagtctggtgactttctccctagggccagcccctgggctgtcgagcctgggaaactccacatccctctccacacctctagaaggactcacaatgaggggggcccagacaggaggcatcaccacctggtttgggctttaccattcacccagggataaggcaaggcaaacaccactccacatcagatctgaatttgagctctggcttcatgacactgacacatgaagactcttggagcctcagattccccagttgttaaatagggagactaatatctcacagagttgtttagacccgaggcgttcaaccttggtggcaatggatgtcaactggaagcatgaaaaatcaccaatgcctgatcctatcctcagagattctgatttaattgttttgggggacagcttgggcatcaggattttaaagagtttccctggtgattttaatgtgaaggtaaggctgagaatccctggttttgacagtacctatagcctataagcctttaatacacctctgaaaatgcctgagacctgaataagaagtttatggttccacagaagcagccagacacaaaaatgcatatgcaccatgtgattccccttatatgaaactgaaagacaggccaaactcgcctttgattgggagtcaggatcaagattaccctgggtcgggggtagcgaatggatggggacctggggggcttctgggagctcaggatgttctgtttcttgatcagagtgccagttacacggggtgctcacttcatgagaattcactgagctgtatacttaagagctgtgtatttgtctgtactggtgatatatttcaataaaattcaccagaaaagcctgttggctacaaaataggaaaagaaaggacacacttgaaattaacgttttgttaaatatctggaaatgtaacacatatgccaaacagacaactgcaactctatgttacgtgtgtgtgtgtgtgtgtgtgtgaaaatgtaatgtctgctctgctgtgggtgggccctctaaaagggaaggtccctgatgcctaagaaaatctgaaaacagcccaggttcacaccaggagttcttaacctcgacccgactgcattcaggtgcatattatgtgccgttatctgaggagagcatctacagctttcagcagattctcaaaggggtatgcaaccccctaaaaaggttaagaacaattggttttgaggagtcagtaagaaactggccatgaatgtgcttggcatgaaagagatgcttggtaatgtcggtttctttccttcctttcagagcccagccttcggaggtttccgcatgagccttctcgggcgacttctaggaggatttattcccctggcagtgccaagggcagcctgcaccaagctcacaactcttcctccaagaggatgttcaaagggcctgtcatttcagcatctgctggacagcagaacttcgcatgcaggatcctggagctgcgtcgggttttgaatcagggacaatggaggaagtgggaaactgtgaagagagtcagagggctgtgccagctgccccctttcccacccccagcaattcacttaactttcctgagtctcacctttgtcattatgagaatgtgtatatttataaataatcatctgtttctccaatgtaagatattgttattgcagaagtgatactaggacctcgttatacgatggcctcatgatgtagatttatagcaggcttcagattctggcatagaataaacagatatttatccaagggttcactgattcccgaataaatgccaggaacattcatgta

SEQ ID NO: 45 - DNA, 4220 bp, Homo sapiens
gagtgcgttcgcggctgctttgacctggtgggcgccgcctccggcactgcaccgaggcggggcgccagcgcccaggttgctgggctggccttggcgcccccttcccctacccagagcgcaggcaggcaggggggtcccgccgcgccccttcagcatatgccggtgcagctgacgacagccctgcgtgtggtgggcaccagcctgtttgccctggcagtgctgggtggcatcctggcagcctatgtgacgggctaccagttcatccacacggaaaagcactacctgtccttcggcctgtacggcgccatcctgggcctgcacctgctcattcagagcctttttgccttcctggagcaccggcgcatgcgacgtgccggccaggccctgaagctgccctccccgcggcggggctcggtggcactgtgcattgccgcataccaggaggaccctgactacttgcgcaagtgcctgcgctcggcccagcgcatctccttccctgacctcaaggtggtcatggtggtggatggcaaccgccaggaggacgcctacatgctggacatcttccacgaggtgctgggcggcaccgagcaggccggcttctttgtgtggcgcagcaacttccatgaggcaggcgagggtgagacggaggccagcctgcaggagggcatggaccgtgtgcgggatgtggtgcgggccagcaccttctcgtgcatcatgcagaagtggggaggcaagcgcgaggtcatgtacacggccttcaaggccctcggcgattcggtggactacatccaggtgtgcgactctgacactgtgctggatccagcctgcaccatcgagatgcttcgagtcctggaggaggatccccaagtagggggagtcgggggagatgtccagatcctcaacaagtacgactcatggatttccttcctgagcagcgtgcggtactggatggccttcaacgtggagcgggcctgccagtcctactttggctgtgtgcagtgtattagtgggcccttgggcatgtaccgcaacagcctcctccagcagttcctggaggactggtaccatcagaagttcctaggcagcaagtgcagcttcggggatgaccggcacctcaccaaccgagtcctgagccttggctaccgaactaagtataccgcgcgctccaagtgcctcacagagacccccactaagtacctccggtggctcaaccagcaaacccgctggagcaagtcttacttccgggagtggctctacaactctctgtggttccataagcaccacctctggatgacctacgagtcagtggtcacgggtttcttccccttcttcctcattgccacggttatacagcttttctaccggggccgcatctggaacattctcctcttcctgctgacggtgcagctggtgggcattatcaaggccacctacgcctgcttccttcggggcaatgcagagatgatcttcatgtccctctactccctcctctatatgtccagccttctgccggccaagatctttgccattgctaccatcaacaaatctggctggggcacctctggccgaaaaaccattgtggtgaacttcattggcctcattcctgtgtccatctgggtggcagttctcctgggagggctggcctacacagcttattgccaggacctgttcagtgagacagagctagccttccttgtctctggggctatactgtatggctgctactgggtggccctcctcatgctatatctggccatcatcgcccggcgatgtgggaagaagccggagcagtacagcttggcttttgctgaggtgtgacatggcccccaagcagagcgggtaaagtgcaatgggtaagggagggaaggggaatggaagagaaaagacagggtgggagggaggagggagtgctgtgttttagtctcttaatggtccaaaggacaaatctaaaatgcaaagaacggtgatgtagtatggcctgacagctctgtttagaggaggcaacactgatcccccagatgcagggctgcaggggattctgtgttttcagactgcctgtctgcttgcatctgcacataggcagtagcctcctcctgggctccagagggcactcagaagttgtgctaaaccaagttaagtcccattcagtggcaacttgtgataggtacctgagtgacggcaacctgcggaaggaggttctcccagcccatctgaacacaaccagaggtggcaggagaatttctactgagcgagctgggccggttagtgtatgtcacccccaccccacccctaagtagtcatcaatgcaataagattgcgcctgagatacaaggcccagaagcctgatctttgggcatcagaaaacagggtccaggaatggtgctttatgtgagataccccactccacatcaacattccagggatgagccaaaccagcagggagttagcactgaactgcttttaaaagtgcacattaaaaaggaaagtttgccaggaggaacaaagagattgtggtggtgctaaaggaggccataagctacacagaggccttgggtgttccacctggaaactgctcagacgtctagatgggttcttagcttgtctgtgatctctgctggggagataaaaagattaagccccaacatgttcagaaaagaagtgaagtcttgggtattttaacctgtatactcttgaattcctctcaaattcagctctgatctgaggctaagacacactccccacttcactttcttcaaagccacattttttgaggtatcactgcagtcacctcttctaccctcatcatcataggtaaggttttcaaggtggcaattggggcggagccccggctcttatagaagcttcagcaggaggcaagcgtgttctcagcacatatgggaactatgaggagcctctgatcaaattggctacaatcttggagctgcttggacggattccttggcagccgggttagcatgtgtgactttcaggctactgttcttgacaatcatctccaatggaaagcttttcagtgttcccaaagtgaactctcaaatccaaaatggttatctttgagaccatccattctcctcagtggcttctccagggaattcttacagccaagttgtgacagtcactgcatttgcctgcttctttccagaaaccaaactaggagatgaaactggttcctacatcctaaggttcttgctttctctctcatgcctcctgaggctgtttttggctgttttccctctgctgcttttggggaatgaggggaagccattttccagtgacttgcaatccaggctgttctcagcgttttgagtttaaaacctgggatcctgactaagcctttgacttaagggttgcttgcttgccctccaaatgtcctttctcagaggggccagctaacccgtgcagaaccagcactaaggtggacagcagacaagagggcaagcctctagtgtaccaagtgcttcctacaaagacgcaaggtgtgctctgagccacagatgggcaaaccctggtgctttccttcatctcccacgaactcaagggttttccaggtgtagctaacagttgccacatcacacagacctcgagtttctggtaagactgctggttgacatcagacccaacccatgaaggctggaaggcagcaggcatttgctaaggcagctgatccaggcaatcgttctgctggccaagaagttaaactattttgagcattagaatggaggaaatccggtcagccaagtgcagagttcagacttcgctaagggcttgtttttcttcagcatttacttgaagattaatgtaggatgacaggctctcctggctgtcctaccatcagctctgccttgcactgtggtcgtcaactttcctcaaatcaaaaacaggcaggtacaggtagtgggctcacaacgtttgacctcgactggtttttctaagttattttgtacatttttcagcagcaaaaccaaactgggtcttcagctttatccccgtttcttgcaagggaagagcctttatacaattggacgcattttggtttttcctcattgagaattcaaatcctcttttgtattgtttctacaataatttgtaaacatatttatttttacctgcttttttttttttttttaattttcaggtcaagttttttatactgcacttatttgtcaaaataaagattctcacatatgccggttatctcgaaa

SEQ ID NO: 46 - DNA, 4213 bp, Homo sapiens
cttcctctcgccgtctcacagtcgctctgcagcctccggcgactggggggatgtgaggccggcgccccagccccccgccccgccatgagccccccgctctgagggccccggcccctggatgcacagccccggcgctgatgggacccaggtgagcccgggtgcccactactgcagccccactggcgcaggctgccccaggccctgtgcagacacaccaggccctcagccgcagcccatggacctgcgggtgggccagcggcccccagtggagcccccaccagagcccacattgctggccctgcagcgtccccagcgcctgcaccaccacctcttcctagcaggcctgcagcagcagcgctcggtggagcccatgaggctctccatggacacgccgatgcccgagttgcaggtgggaccccaggaacaagagctgcggcagcttctccacaaggacaagagcaagcgaagtgctgtagccagcagcgtggtcaagcagaagctagcggaggtgattctgaaaaaacagcaggcggccctagaaagaacagtccatcccaacagccccggcattccctacagaaccctggagcccctggagacggaaggagccacccgctccatgctcagcagctttttgcctcctgttcccagcctgcccagtgaccccccagagcacttccctctgcgcaagacagtctctgagcccaacctgaagctgcgctataagcccaagaagtccctggagcggaggaagaatccactgctccgaaaggagagtgcgccccccagcctccggcggcggcccgcagagaccctcggagactcctccccaagtagtagcagcacgcccgcatcagggtgcagctcccccaatgacagcgagcacggccccaatcccatcctgggctcggaggcgctcttgggccagcggctgcggctgcaggagacttctgtggccccgttcgccttgccgacagtgtccttgctgcccgcaatcactctggggctgcccgcccctgccagggctgacagtgaccgcaggacccatccgactctgggccctcgggggccaatcctggggagcccccacactcccctcttcctgccccatggcttggagcccgaggctgggggcaccttgccctctcgcctgcagcccattctcctcctggacccctcaggctctcatgccccgctgctgactgtgcccgggcttgggcccttgcccttccactttgcccagtccttaatgaccaccgagcggctctctgggtcaggcctccactggccactgagccggactcgctcagagcccctgccccccagtgccaccgctcccccaccgccgggccccatgcagccccgcctggagcagctcaaaactcacgtccaggtgatcaagaggtcagccaagccgagtgagaagccccggctgcggcagataccctcggctgaagacctggagacagatggcgggggaccgggccaggtggtggacgatggcctggagcacagggagctgggccatgggcagcctgaggccagaggccccgctcctctccagcagcaccctcaggtgttgctctgggaacagcagcgactggctgggcggctcccccggggcagcaccggggacactgtgctgcttcctctggcccagggtgggcaccggcctctgtcccgggctcagtcttccccagccgcacctgcctcactgtcagccccagagcctgccagccaggcccgagtcctctccagctcagagacccctgccaggaccctgcccttcaccacagggctgatctatgactcggtcatgctgaagcaccagtgctcctgcggtgacaacagcaggcacccggagcacgccggccgcatccagagcatctggtcccggctgcaggagcgggggctccggagccagtgtgagtgtctccgaggccggaaggcctccctggaagagctgcagtcggtccactctgagcggcacgtgctcctctacggcaccaacccgctcagccgcctcaaactggacaacgggaagctggcagggctcctggcacagcggatgtttgtgatgctgccctgtggtggggttggggtggacactgacaccatctggaatgagcttcattcctccaatgcagcccgctgggccgctggcagtgtcactgacctcgccttcaaagtggcttctcgtgagctaaagaatggtttcgctgtggtgcggcccccaggacaccatgcagatcattcaacagccatgggcttctgcttcttcaactcagtggccatcgcctgccggcagctgcaacagcagagcaaggccagcaagatcctcattgtagactgggacgtgcaccatggcaacggcacccagcaaaccttctaccaagaccccagtgtgctctacatctccctgcatcgccatgacgacggcaacttcttcccggggagtggggctgtggatgaggtaggggctggcagcggtgagggcttcaatgtcaatgtggcctgggctggaggtctggacccccccatgggggatcctgagtacctggctgctttcaggatagtcgtgatgcccatcgcccgagagttctctccagacctagtcctggtgtctgctggatttgatgctgctgagggtcacccggccccactgggtggctaccatgtttctgccaaatgttttggatacatgacgcagcaactgatgaacctggcaggaggcgcagtggtgctggccttggagggtggccatgacctcacagccatctgtgacgcctctgaggcctgtgtggctgctcttctgggtaacagggtggatcccctttcagaagaaggctggaaacagaaacccaacctcaatgccatccgctctctggaggccgtgatccgggtgcacagtaaatactggggctgcatgcagcgcctggcctcctgtccagactcctgggtgcctagagtgccaggggctgacaaagaagaagtggaggcagtgaccgcactggcgtccctctctgtgggcatcctggctgaagataggccctcggagcagctggtggaggaggaagaacctatgaatctctaaggctctggaaccatctgcccgcccaccatgcccttgggacctggttctcttctaacccctggcaatagcccccattcctgggtctttagagatcctgtgggcaagtagttggaaccagagaacagcctgcctgctttgacagttatcccagggagcgtgagaaaatccctgggtctagaatgggaactggagaggaccctgagaggagacgggctgggcggcgacccccacagggctctcgagaacagattctcccctccagtatgggccctggctgtggcccccattcctcaggactgcacagaggaggactggctccggctccgtcgggctcacccttaaccactattcctggctctgcaaaccccagactttgcacacagcctcaggctccacacagaaatgtgaacttggcctcagacaggctggcccttcctaggctctaggggctaggggggagtggggagccaagaggtcccatattcctgagtgcaggggtagtccctctcacctgcttcctcagacgactctggaagcttccctctaccactgggcactgagacgaagctccctgacagccgagactggcagccctccatctggtccgtaccctcgccagaggcccccctacatcaacctcctggcgatgccctggtggagcagatgggtgctctgggagtcctgtgcttcctgatccaatggtgccaaacccttcatctccccaagaagcgcagcatacccctgggacccctcggccactgcccactcggggagccttctctgtttctggggcctcccccaccatagctctgattcccaccccacataggagtagcctgactgagggggaaggggtgggagagaagatacagacatggaggaggggaggctgctctggcaaagtcttcaaggcttttgggggtccaggcctggggtcaagaaggaaaatgtgtgtgagcatgtgtgtgagtgaggcgtgtgtgtgagcgtgtgtgtgagtgaggcgtgtgtgtgtgtctttcctaggacccaccataccctgtgtatgtatgcatgtttttgtaaaaaggaagaaaatggaaaaaaatctgaacaataaatgttttatttgctttaaaa

SEQ ID NO: 47 - DNA, 1614 bp, Homo sapiens
aatctccccctcccaaaatcgctccattacataaatcggggggggtgcaggaggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataataccaaaaaaaaaaaaaa

SEQ ID NO: 48 - DNA, 3627 bp, Homo sapiens
ctgggtagggcagggggaaccgacaggccggtgtccccagccgcaaaagagctgctgaactgtccgtttaaatgctgctgggagactcgtaaaaaaatcatcgtggacctggaggatgagaggggcgagctttatttcggtcggattgcggtgtggtggtttagctgcaaggggatgccgcagccccagttgagggggaaaatagttcttaaaaagcatatgcccccctaaggaatgtctctaaagaaccaaatcaaagctgctctttggaaggtatgaatagaatttaaaaaaaaaagatttctatggagcttaaagttcacagccattctgtgtagacaagagctaagaaaaatgtgagaattatacagaaaaccattaatcacttcttttctttaaatacgtatcctctctcctttgttattattcaacagcaaatctccttggaccggctgttgggggaaaaaagtgttagccgtctctcccggatctgcaagggggaaaaaatttggaaccataaagttgaaaacttttttctctcagtttggaagaagcccttcgtcatgaatgggatctgcagagttcgggcgagaggaggcgagaggcgcaaaggaggggagatttgtcgcctgccgctcgctctggggctcgatgtgaatatatattatgtctgcctgttctcccctcgtcggtggctaaggtcagccgcttggaacagaccccggaggaggggggcagagaggggaggtggggggggggggtccggcgtgtcacgtgacccccagggttgccaatgtccggtcctgagggtatcaggcctttccaagttgccacccactgcccaggcctcacccagcgatgcagaaagccacctactacgacaacgccgcggctgctctcttcggaggctattcctcgtaccctggcagcaatggcttcggcttcgatgtccccccccaacccccatttcaggccgccacgcacctggagggcgactaccagcgctcagcttgctcgctgcagtccctgggcaacgctgccccacatgccaagagcaaggagctcaacggcagctgcatgaggccgggtctggcccccgagcccctgtcggccccgcctggctcacccccgcccagtgccgcacctaccagtgccactagcaacagcagtaatgggggcgggcccagcaaaagtggtcccccaaagtgcggtcccggcaccaactccaccctcaccaaacagatattcccctggatgaaagagtcgaggcaaacgtccaagctgaaaaacaactcccccggcacagcagagggctgtggtggcggcggcggtggcggcggcggcggaggcagtggtggcagcgggggcggtggcggcggcggcgggggaggggacaagagccccccggggtcggcggcgtccaagcgggcgcggacggcgtacacgagcgcgcagctggtggagctggagaaggagttccattttaaccgctacctgtgccggcctcgccgtgtagagatggccaacctgctgaacctcagcgagcggcagatcaagatctggttccagaaccggcgcatgaagtacaagaaggaccagaaggccaagggattggcctcgtcgtcggggggcccatctccagccggcagccccccgcagcccatgcagtccacggccggcttcatgaacgccttacactccatgacccccagctacgagagcccgtccccacccgccttcggtaaagcccaccagaatgcctacgcgctgccctccaactaccagccccctctcaaaggctgcggcgccccgcagaagtaccctccgaccccggcgcccgagtatgagccgcacgtcctccaagccaacgggggcgcctacgggacgcccaccatgcagggcagtccggtgtacgtgggcgggggcggctacgcggatccgctgccgccccctgccggcccctccctctatggcctcaaccacctttcccatcacccttccgggaacctggactacaacggggcgccccctatggcgcccagccagcaccacggaccctgcgaaccccaccccacctacacagacctctcctctcaccacgcgcctcctcctcagggtagaatccaagaagcgcccaaattaacacacctgtgatgggaaagggcgaacgaggattaggggatggggaggaagagagagactgtggagctctggggggcaacctggaggtctgaaaagaggagccagagaaggtggtacccaggcttcctggtcagaaccggcctggagctccttcccttccccctggcctgagaggttgcttttaagtcttccaccccttgttccatctgcctgccaacccatcggaaaggaatccacatcatattggagatgaccccatcaaccccagggctccagcactaccaagttggaattccacgcccgggagtggggtagaggaagacgagacaggacgaggcagaaaagcacattttaaaaaccagacaagatggctaggccatcaccaaccaacggacttaccttacatctttgtaggtaattccccccaaatcttgatttttttttttcctcaattatcctttaaaaaataagaaaacacatttcaaacccaaaaggcacaaaacacgttcccttccaactttcccaaaacctcaaatttgttcccatttgaggtttattgaggtacacttctagcccccggtttttctgctctagaacattcatatctatacatcccacccccatcaattacagtttttagagggctcagggatggtgagagatcctgaaagagctgcctatattataaattatatacatttttttttaaggaaaagtgtggaggctagggcaggcaggttgttaggactgaaggtttgcccattctgctgcctccatctcagctccagctccatccccctctccacagaaagcagttggtgacacgaggttctatacttttcttctgttgctctcttgacttaacgtgaaaacagggtatatttgaacaaactgtcccaggcaggggctgggcagggcctgtgtgccttgctcagcctcctgacaggacacttttgttgcacttagaatttacattttaatggatgtaaaaacaactgtgagagatgtctgggcctgcagaagtccagcattgctcaaaaaagcgtgtgttctagtgaacattttcatatatatttattggttatagcctgttaaaatattttcttttttgtattatttatccccctacattatgtatttatatgagggaaaaaaaggaaaaaattgtacttttttagtatttacctgttacaaaggacattgtgtttcctgtcatgtaaaaccagctattttagttactattgtactctagaaaagagctgtagatttatgttaaactcgtacttacgaacaattgtaattagttctaaaaggcatgaactcagctcctaatcgtcactgtatagtcctgaatttgtagaactagagttaattccctcttggaactttctttgttcttcagtagttacttttttccttacctaaaagggttgtctgtcaaacaattcttgaataaactttctgttatcaattttaaaaaaaaaa

SEQ ID NO: 49 - DNA, 2002 bp, Homo sapiens
agtatattttgtgggcaattcccagaaattaatggctatgagttcttttttgatcaactcaaactatgtcgaccccaagttccctccatgcgaggaatattcacagagcgattacctacccagcgaccactcgcccgggtactacgccggcggccagaggcgagagagcagcttccagccggaggcgggcttcgggcggcgcgcggcgtgcaccgtgcagcgctacgcggcctgccgggaccctgggcccccgccgcctccgccaccacccccgccgcccccgccaccgcccggtctgtcccctcgggctcctgcgccgccacccgccggggccctcctcccggagcccggccagcgctgcgaggcggtcagcagcagccccccgccgcctccctgcgcccagaaccccctgcaccccagcccgtcccactccgcgtgcaaagagcccgtcgtctacccctggatgcgcaaagttcacgtgagcacggtaaaccccaattacgccggcggggagcccaagcgctctcggaccgcctacacgcgccagcaggtcttggagctggagaaggaatttcactacaaccgctacctgacacggcgccggagggtggagatcgcccacgcgctctgcctctccgagcgccagatcaagatctggttccagaaccggcgcatgaagtggaaaaaagaccacaagttgcccaacaccaagatccgctcgggtggtgcggcaggctcagccggagggccccctggccggcccaatggaggcccccgcgcgctctagtgcccccgcacgcgggagccacgaacctcggggtgggggtgggcagtgagtgcaggggatggggtggggggacaggagggggccctggggcctgggccccggaaaaatctatctgccctcccccacactttatatacgaataaacgcagaagagggggaggggaagctttatttatagaaatgacaatagagggccacggggaggcccccccagaagcaagattcaaatctcttgctttctttcttaaaaaaaagaaaaagaaaaagcaagaagaaggaagaaagaaaaagacagaaagagaaataggaggaggctgcagctcctcgttttcagctttggcgaagatggatccacgtttcatctttaatcacgccaggtccaggcccatctgtcttgtttcctctgccgaggagaagacgggcctcggtggcgaccattacctcgacacccgctaacaaatgaggcccggctcggccgcctccgcctctgctactgccgctgctggaagacagcctggatttcctttctttgtcccccactcccgatacccagcgaaagcaccctctgactgccagatagtgcagtgttttggtcacggtaacacacacacactctccctcatctttcgtgcccattcactgagggccagaatgactgctcacccacttccaccgtggggttgggggtgggcaacagaggaggggagcaagtagggaagggggtggccttgacaactcaggagtgagcaggaaaattgagtccaaggaaaaagagagactcagagacccgggagggccttcctctgaaaggccaagccaagccatgcttggcagggtgaggggccagttgagttctgggagctgggcactactctgccagtccagagttgtacagcagaagcctctctcctagactgaaaatgaatgtgaaactaggaaataaaatgtgcccctcccagtctgggaggaggatgttgcagagccctctcccatagtttattatgttgcatcgtttattattattattgataatattattattactatttttttgtgtcatgtgagtcctctctccttttctctttctgacattccaaaaccaggccccttcctacctctggggctgcttgagtctagaacccttcgtatgtgtgaatatctgtgtgctgtacagagtgacaatagaaataaatgtttggtttcttgtgaccagca

SEQ ID NO: 50 - DNA, 1676 bp, Homo sapiens
agcattcttttggacaccacacctaggtcggagcactgtcgtccttcagggctccagcctcttgatatttttgtacttcagtatcagctcgatagagcaaaagagagagaggacgagagagggggtcagagaaggggaagcaacggctctcacgttgggacaatattatctggaagctgaagaagaaactgaatactccttccttcctccccacccattcctttaaatccggagggggaaaaaatcccaaggtctgcaaaggcgcggcgctcggactataaaacacaacaaatcataaacccggcggagcagcagcggccgcgcgcgcctcccctcccaatgagttcctatttcgtgaactccaccttccccgtcactctggccagcgggcaggagtccttcctgggccagctaccgctctattcgtcgggctatgcggacccgctgagacattaccccgcgccctacgggccagggccgggccaggacaagggctttgccacttcctcctattacccgccggcgggcggtggctacggccgagcggcgccctgcgactacgggccggcgccggccttctaccgcgagaaagagtcggcctgcgcactctccggcgccgacgagcagcccccgttccaccccgagccgcggaagtcggactgcgcgcaggacaagagcgtgttcggcgagacagaagagcagaagtgctccactccggtctacccgtggatgcagcggatgaattcgtgcaacagttcctcctttgggcccagcggccggcgaggccgccagacatacacacgttaccagacgctggagctggagaaggagtttcactacaatcgctacctgacgcggcggcggcgcatcgagatcgcgcacgccctgtgcctgacggagaggcagatcaagatatggttccagaaccgacgcatgaagtggaaaaaggagagcaaactgctcagcgcgtctcagctcagtgccgaggaggaggaagaaaaacaggccgagtgaaggtgctggaaagggagggaggacgcgaggggaaaggcctgtggggagccgagggcgtcagagagacccgggaaggaaggctctcgggtgggggagccaggagacctgctctccggcgcagacaggcggggcccagcgctctcctggacgcccccgcccgcacagctcccggcgggtgctctgaggcctcactactcgagcccacccagcatcccgcgcgcccttccttcccgaggaactcgcctcagcctgatcaggcttcctggtgagaactgaggagcggactcacttgatgtttcctggaagcagagcaaaatgctcttgtccctgtcgcgtctcattttgtccatgtcccccgtgcacggttcaatggtagattcgctgtcccctcagcgggggccttgaagactccctgatcccagacctgtcgtctctcccaccccctccccaaagccactggaaggagcacatactacctagaagtaagaagaggagcctcagaagaaaacaaagttctattttattaattttctatgtgttgtgtttgtagtcttgtcttagctctggacgtgaaatacttcgatgatgatgatgatgatgatgatgataataataataataataacaacaacaacaacaataataaagatgtgaaaactcga

SEQ ID NO: 51 - DNA, 1886 bp, Homo sapiens
gccatgggttggagagggcagctcgggtagagagggctggcggagcggcgcagacggcggcagtcctgctcagcctctgcccggctccgtactccggccccggcctgcgccctcagaaaggtggggcccgaaccatgagctcctacctggagtacgtgtcatgcagcagcagcggcggggtcggcggcgacgtgctcagcttggcacccaagttctgccgctccgacgcccggcccgtggctctgcagcccgccttccctctgggcaacggcgacggcgccttcgtcagctgtctgcccctggccgccgcccgaccctcgccttcgcccccggccgcccccgcgcggccgtccgtaccgcctccggccgcgccccagtacgcgcagtgcaccctggagggggcctacgaacctggtgccgcacctgccgcggcagctgggggcgcggactacggcttcctggggtccgggccggcgtacgacttcccgggcgtgctggggcgggcggccgacgacggcgggtctcacgtccactacgccacctcggccgtcttctcgggcggcggctctttcctcctcagcggccaggtggattacgcggccttcggcgaacccggcccttttccggcttgtctcaaagcgtcagccgacggccaccctggtgctttccagaccgcatccccggccccaggcacctaccccaagtccgtctctcccgcctccggcctccctgccgccttcagcacgttcgagtggatgaaagtgaagaggaatgcctctaagaaaggcaaactcgccgagtatggggccgctagcccctccagcgcgatccgcacgaatttcagcaccaagcaactgacagaactggaaaaagagtttcatttcaataagtacttaactcgagcccggcgcatcgagatagccaactgcttgcacctgaatgacacgcaagtcaaaatctggttccagaaccgcaggatgaaacagaagaaaagggaacgagaagggcttctggccacggccattcctgtggctcccctccaacttcccctctctggaacaacccccactaagtttatcaagaaccccggcagcccttctcagtcccaagagccttcgtgaggccggtacttggggccgaaaaactgtggcctgcagaagtcccaggcgacccccatccctatctagacttaggagctcagtttgggatggaggtgggagaacaaaaatgaatagggatttcacttgggaaatgaagtactttagttggcttccgagttccagactatatgtccagatattaattgactgtcttgtaagccacttgtttggttatgatttgtgtcttatcagggaaaaggtgcccagctgccagcccagctccgctgctatctttgcctcacttagtcatgtgcaattcgcgttgcagagtggcagaccattagttgctgagttctgtcagcactctgatgtgctcagaagagcacctgcccaaagtttttctggttttaatttaaaggacaaggctacatatattcagctttttgagatgaccaaagctagttagggtctccttgatgtagctaagctgcttcagtgatcttcacatttgcactccagtttttttttctttaaaaaagcggtttctacctctctatgtgcctgagtgatgatacaatcgctgtttagttactagatgaacaaatccacagaatgggtaaagagtagaatctgaactatatcttgacaaatattattcaaacttgaatgtaaatatatacagtatgtatattttttaaaaagatttgcttgcaatgaccttataagtgacatttaatgtcatagcatgtaaagggttttttttgtaataaaaattatagaatctgc

SEQ ID NO: 52 - DNA, 2449 bp, Homo sapiens
ggagtcgtcattaatctgccacgcaaagggctctctccgacttggaaagtgcagggatcccaagaatatcacccgtccaggggggccgcgcggtgcccccggccctccacccccggcccccggcgggcgcgggagcgcggccgcagattcgcctccacagatatcaaaagaaacctgaagagcctacaaaaaaaaaagagataaagacaaaattcaagaaaacacacacatacataattgtggtcacctggagcctgggggccggcccagctctctcaggattcagcagacattggaggtggcagtgaaggatacagtggtagtcaatgttatttgagcagggtcagcaggccctggagcttcctgagtgcacaatgcagaaggctgcttactatgaaaacccaggactgtttggaggctatggctacagcaaaactacggacacttacggctacagcaccccccaccagccctacccaccccctgctgctgccagctccctggacactgactatccaggttctgcctgctccatccagagctctgcccctctgagagccccagcccacaaaggagctgaactcaatggcagctgcatgcggccgggcactgggaacagccagggtgggggtggtggcagccagcctcctggtctgaactcagagcagcagccaccacaaccccctcctccaccaccgaccctgcccccatcttcacccaccaatcctggaggtggagtgcctgccaagaagcccaaaggtgggcccaatgcttctagctcctcagccaccatcagcaagcagatcttcccctggatgaaagagtctcgacagaactccaagcagaagaacagctgtgccactgcaggagagagctgcgaggacaagagcccgccaggcccagcatccaagcgggtacgcacggcatacacgagcgcgcagctggtggaattggaaaaggaattccacttcaaccgctacttgtgccggccgcgccgcgtggagatggccaacctgctgaatctcacggaacgccagatcaagatctggttccagaaccggcgcatgaagtacaagaaggaccagaaggccaagggcatcctgcactcgccggctagccagtcccctgagcgcagcccaccgctcggcggcgccgctggccacgtggcctactccggccagctgccgccagtgcccggcctggcctacgacgcgccctcgccgcctgctttcgccaaatcacagcccaatatgtacggcctggccgcctacacggcgccactcagcagctgcctgccacaacagaagcgctacgcagcgccggagttcgagccccatcccatggcgagcaacggcggcggcttcgccagcgccaacttgcagggcagcccggtgtacgtgggcggcaacttcgtcgagtccatggcgcccgcgtccgggcctgtcttcaacctgggccacctctcgcacccgtcgtcggccagcgtggactacagttgcgccgcgcagattccaggcaaccaccaccatggaccttgcgaccctcatcccacctacacagatctctcggcccaccactcgtctcagggacgactgccggaggctcccaaactgacgcatctgtagcggccgccgccagcccgaactcgcggcaaaattacctctcttgctgtagtggtggggtagagggtggggcccgcggggcagttcgggaacccccttccccgctcttgccctgccgccgcctcccgggtctcaggcctccagcggcggaggcgcaggcgaccgggcctcccctccatgggcgtcctttgggtgactcgccataaatcagccgcaaggatccttccctgtaaatttgacagtgccacatactgcggaccaagggactccaatctggtaatggtgtcccaaaggtaagtctgagacccatcagcggcgcgccctgcagagggaccagagcttggagagtcttgggcctggcccgcgtctagcttagtttcagagaccttaatttatattctccttcctgtgccgtaaggattgcatcggactaaactatctgtatttattatttgaagcgagtcatttcgttccctgattatttatccttgtctgaatgtatttatgtgtatatttgtagatttatccagccgagcttaggaattcgcttccaggccgtgggggccacatttcacctccttagtccccctggtctgaactagttgagagagtagttttgaacagtcgtaaccgtggctggtgtttgtagttgacataaaggattaagaccgcaaattgtccttcatgggtagagtcaggaagcccggtggcgtggcacaacacactttggtcatttctcaaaaaccacagtcctcaccacagtttattgatttcaaattgtctggtactattggaacaaatatttagaataaaaaaatttcccagtc

SEQ ID NO: 53 - DNA, 1136 bp, Homo sapiens
agttgacagcaagtaggagggccctatggaaggagaaaaaaagacaacacgagaaaaattagtattttctaccttctgaaattaatggtcatgagttcgtatatggtgaactccaagtatgtggaccccaagttccctccgtgcgaggagtatttgcagggcggctacctaggcgagcagggcgccgactactacggcggcggcgcgcagggcgcagacttccagcccccggggctctacccacggcccgacttcggtgagcagcctttcggaggcagcggccccgggcctggctcggcgctgcctgcgcggggtcacggacaagagccaggcggccccggcggtcactacgccgctccaggagagccttgcccagctcccccggcgcctccgccggcgcccctgcctggcgcccgggcctacagtcagtccgaccccaagcagccgccctccgggacggcactcaagcagccggccgtggtctacccctggatgaagaaggtgcacgtgaattcggtgaaccccaactacaccggtggggaacccaagcggtcccgaacggcctacacccggcagcaagtcctagaactggaaaaagaatttcattttaacaggtatctgacaaggcgccgtcggattgaaatcgctcacaccctgtgtctgtcggagcgccagatcaagatctggttccagaaccggaggatgaagtggaaaaaagatcataagctgcccaacactaaaggcaggtcatcgtcctcatcttcctcctcatcttgctcctcctcagtcgcccccagccagcatttacagccgatggccaaagaccaccacacggacctgacgaccttatagaagtggggaccctgggcccatctctccctgcgcaccaggctgagccgaagctgcgggggcaggccgggcctgctgtcacctcgctgggctctaaggtactgtggggtggacctgggacaagcaggccgccctcggactaggttagcatcctgcccgagggcagccccctccctagagcgggatggggatgggagggggggcgggattctctctctaagtatattatatggcaggagctactgagaacataaaatcttggcgagtcattaaacttatgaaaatca

SEQ ID NO: 54 - DNA, 1434 bp, Homo sapiens
acccactgggaatatgattatgcttaatctatgctcagttgaaaggggctggggctgctttctcccctcccttcttgactctctgttcacagaactcaggctgcctccagccagcctttgcccgctagactcactggccctgagcacttgaaggtgcagcaagtcactgagaatgagcactttcttctcggacacagcatggatctgcctggctgtccccacagtactatgtgggacagtattttgcaaatacaagaagagctcagggcagctgtggagctggatggtctgcctggcaggcctctgtgcagtctgcctgctcatcctgtcccctttttggggcttgatcctcttctcggtgtcatgcttcctcatgtatacttacttatctggccaagaattgttacctgtggatcagaaggcagtcctggtgacaggtggtgattgcgggcttggccatgctttgtgcaagtatctggatgagctgggcttcacggtatttgccggagttttgaatgaaaatggcccaggagctgaggaattgcgaagaacctgctctccgcgcctctcggtgctccaaatggacatcacgaagccagtgcagataaaagatgcttacagcaaggttgcagcaatgctgcaggacagaggactgtgggctgtgatcaacaatgctggggtgcttggctttccaactgatggggagcttcttcttatgactgactacaaacaatgcatggccgtgaacttctttggaactgtggaggtcacaaagacgtttttgcctcttcttagaaaatccaaagggaggctggtgaatgtcagcagcatgggaggaggggccccaatggaaaggctggcatcttatggctcatcaaaggcggctgtgaccatgttctcatcagttatgagactggagctttccaagtggggaattaaagttgcttccatccaacctggaggcttcctaacaaatatcgcaggcaccagtgacaagtgggaaaagctggagaaggacattctggaccacctccccgctgaggtacaggaagactacggccaggactacatcttagcacagcggaatttcctcctattgatcaactcgttagccagcaaggacttctctccggtgctgcgggacatccagcatgctatcttggcgaagagcccttttgcctattacacgccagggaaaggcgcttacttgtggatctgccttgctcactatttgcctattggcatatatgattactttgctaaaagacattttggccaagacaagcccatgcccagagctctaagaatgcctaactacaagaaaaaggccacctaggcaatggaagccctcaaagaagtcggaatgtcatagtcttgaaatgaaagggaaactgggaaactgggtttctcattaaagttgtttcccactctgta

SEQ ID NO: 55 - DNA, 3369 bp, Homo sapiens
gcactccgcaacttctgccgctgccgcccgggcgctctcggcgcagccgagctgctgctgcgaactgtggagctgccagcggagcccagcccgagctccctcgactccgcgcgtcccaggcgtccgtcgggggccgaagcgcctcccgcagggagtccccgtgaggccgcgctgccgcgttacccgcagcggccgggggtccggggagtgcggggctccgagacagagccaggcgccccccagcggtcggcgcgggccccatggctgggccgggcggagcggaaccggtgaggtgaagccccggggccggcagccggaggcgcgtggccggggcgccggctccatgggcagcggcacacggcggcgcgatgatggacgttaacagcagcggccgcccggacctctacgggcacctccgctctttccttctgccagaagtggggcgcgggctgcccgacttgagccccgacggtggcgccgacccggtcgcgggctcctgggcgccgcacctgctgagcgaggtgacagccagcccggcgcccacctgggacgcgcccccggacaatgcctccggctgtggggaacagatcaactacggcagagtcgagaaagttgtgatcggctccatcctgacgctcatcacgctgctgacgatcgcgggcaactgcctggtggtgatctccgtgtgcttcgtcaagaagctccgccagccctccaactacctgatcgtgtccctggcgctggccgacctctcggtggctgtggcggtcatgcccttcgtcagcgtcaccgacctcatcgggggcaagtggatctttggacactttttctgtaatgtcttcatcgccatggacgtcatgtgctgcacggcctcgatcatgaccctgtgcgtgatcagcattgacaggtaccttgggatcacaaggcccctcacataccctgtgaggcagaatgggaaatgcatggcgaagatgattctctccgtctggcttctctccgcctccatcaccttacctccactctttggatgggctcagaatgtaaatgatgataaggtgtgcttgatcagccaggactttggctatacgatttactctaccgcagtggcattttatatccccatgtccgtcatgcttttcatgtactaccagatttacaaggctgccaggaagagtgctgccaaacacaagtttcctggcttccctcgagtggagccagacagcgtcatcgccctgaatggcatagtgaagctccagaaggaggtggaagagtgtgcaaacctttcgagactcctcaagcatgaaaggaaaaacatctccatctttaagcgagaacagaaagcagccaccaccctggggatcatcgtcggggcctttaccgtgtgctggctgccatttttcctcctctcgacagccagacccttcatctgtggcacttcctgcagctgcatcccactgtgggtggagaggacatttctgtggctaggctatgcaaactctctcattaacccttttatatatgccttcttcaaccgggacctgaggaccacctatcgcagcctgctccagtgccagtaccggaatatcaaccggaagctctcagctgcaggcatgcatgaagccctgaagcttgctgagaggccagagagacctgagtttgtgctacaaaatgctgactactgtagaaaaaaaggtcatgattcatgattgaaagcagaacaatggagatgaaataaacaaggcaaaatagaggtggaaacagaaggaagtcatttgctgagtctgcagaatggaatgcagcttctgtcctttcttgggatgtctaaaacatgacaaacagggtgatctgttgtacacactatcttatgagggagatggtgacttctccttttttctgtggatcagtgctattgtgtgttctcagtttaagatagcagatcatctcagcagtaagcacaccaacagaactgagttccagaaaggaagcagtttctggtgctttgcatatgtccaaatccatgcaagtgggagaaagttccagtgcacacttcccatgcttctgagtctaggcgttgtggtgaatatgcaggaatcattcatgagacagaatgtattttgttgtatgacagaaggcttttccaagcaaactgcggtgagcgtagtgttgaatatgttgcatgtccatgttagaaaacagaatccagtcatcagctaatacaaatgatttcccagagcagtgtttgtttcaagcttctgtcaaatagtttggcttttctgcagggtctctgtgatttccccacctatgtacttttctgtgttaactcacttattatggtataactcaggaacaggtctcaggatggagagaagcatacaacatgagcaaagctttttctcgtgctctgaagggtcttgagaggggagtgggatgccttctgtgaggatttttatcgcagtgaagctcaagtggtacccaactgcgttgtaattaacatgattattggcatgtttttgactctcattttctacaaggctgcagtgggcccacccatgggctggcccataactgtatgttatgtggaagaagtgtgggaatgatgggttttccatgaaatgtgatgcttctggagatggggcataaacatgttcattcttgttgagctgcattgtgttaaaccaaattgtgtgaagcgaggtcacctggaccactcttgggaaatgcttcagaacaccagtctgttccttctagagaatttgtttttgtgttctatgtatcttaaatcaaatgtgtgcctaagcaattctgtcctctgattcccacccctacccaccaaaaaatggtagacatgaaaggcaggtgaggaaacagaaaaggtctctttgcagatatatattttttaaatggcactatgtagtaattaagagctaaggagacagaaagacagtagatgagaatagaagagtacctgtacctacaaggggaaaaatgaatgcaattctttatttgataagagtgaactgaaagagaatattattttcctacaataaagcaagctgtcctctcacaggataaagtggaattctgacatggattatggacttcttctaactcccattgacattgcttcttaccagacatggggaaaagctacctttcctgaaaggggaggagggcactgtcctttcagacaaagcttgtacaaattcctgaaccgcaaatttgctgaagtgaccgtatatattatattcataatttaaatgattatttatggtcagatacatattgttaaacttgaaaatgttttattacattacatcaaataaagtttatttgtagctgaaataaagcaacgtaagtaacaatttttaa

SEQ ID NO: 56 - DNA, 2205 bp, Homo sapiens
agccgctcagccccctgcccctcgccgcccgccgcctgcctgggccgggccgaggatgcggcgcagcgcctcggcggccaggcttgctcccctccggcacgcctgctaacttcccccgctacgtccccgttcgcccgccgggccgccccgtctccccgcgccctccgggtcgggtcctccaggagcgccaggcgctgccgccgtgtgccctccgccgctcgcccgcgcgcccgcgctccccgcctgcgcccagcgccccgcgcccgcgcccagtcctcgggcggtcatgctgcccctctgcctcgtggccgccctgctgctggccgccgggcccgggccgagcctgggcgacgaagccatccactgcccgccctgctccgaggagaagctggcgcgctgccgcccccccgtgggctgcgaggagctggtgcgagagccgggctgcggctgttgcgccacttgcgccctgggcttggggatgccctgcggggtgtacaccccccgttgcggctcgggcctgcgctgctacccgccccgaggggtggagaagcccctgcacacactgatgcacgggcaaggcgtgtgcatggagctggcggagatcgaggccatccaggaaagcctgcagccctctgacaaggacgagggtgaccaccccaacaacagcttcagcccctgtagcgcccatgaccgcaggtgcctgcagaagcacttcgccaaaattcgagaccggagcaccagtgggggcaagatgaaggtcaatggggcgccccgggaggatgcccggcctgtgccccagggctcctgccagagcgagctgcaccgggcgctggagcggctggccgcttcacagagccgcacccacgaggacctctacatcatccccatccccaactgcgaccgcaacggcaacttccaccccaagcagtgtcacccagctctggatgggcagcgtggcaagtgctggtgtgtggaccggaagacgggggtgaagcttccggggggcctggagccaaagggggagctggactgccaccagctggctgacagctttcgagagtgaggcctgccagcaggccagggactcagcgtcccctgctactcctgtgctctggaggctgcagagctgacccagagtggagtctgagtctgagtcctgtctctgcctgcggcccagaagtttccctcaaatgcgcgtgtgcacgtgtgcgtgtgcgtgcgtgtgtgtgtgtttgtgagcatgggtgtgcccttggggtaagccagagcctggggtgttctctttggtgttacacagcccaagaggactgagactggcacttagcccaagaggtctgagccctggtgtgtttccagatcgatcctggattcactcactcactcattccttcactcatccagccacctaaaaacatttactgaccatgtactacgtgccagctctagttttcagccttgggaggttttattctgacttcctctgattttggcatgtggagacactcctataaggagagttcaagcctgtgggagtagaaaaatctcattcccagagtcagaggagaagagacatgtaccttgaccatcgtccttcctctcaagctagccagagggtgggagcctaaggaagcgtggggtagcagatggagtaatggtcacgaggtccagacccactcccaaagctcagacttgccaggctccctttctcttcttccccaggtccttcctttaggtctggttgttgcaccatctgcttggttggctggcagctgagagccctgctgtgggagagcgaagggggtcaaaggaagacttgaagcacagagggctagggaggtggggtacatttctctgagcagtcagggtgggaagaaagaatgcaagagtggactgaatgtgcctaatggagaagacccacgtgctaggggatgaggggcttcctgggtcctgttccctaccccatttgtggtcacagccatgaagtcaccgggatgaacctatccttccagtggctcgctccctgtagctctgcctccctctccatatctccttcccctacacctccctccccacacctccctactcccctgggcatcttctggcttgactggatggaaggagacttaggaacctaccagttggccatgatgtcttttcttctttttcttttttttaacaaaacagaacaaaaccaaaaaatgtcca

SEQ ID NO: 57 - DNA, 4889 bp, Homo sapiens
agatccgccgcgaagccgggatcgaaggcgacagcgcggccaagggggcgcggccgggacaagctgggggccggttgcccggggcagggacggcggcgacccggccgctggggaggcaggaagatagacccacggatcttaggaagggatccgagagcgcagctgtgaaactggctggggctgggggcacgaaaccgatcagcgctacggagcgcagcggccggcgggttccagtgtcctccggcggcgcggggagcaggtgaacaggtcctcacgcccagctccgcgccctcacgcgctctcgccgggaccccgcttccgctggcagccatgggccccggccccagccgcgcgccccgcgccccacgcctgatgctctgtgcgctcgccttgatggtggcggccggcggctgcgtcgtctccgccttcaacctggatacccgattcctggtagtgaaggaggccgggaacccgggcagcctcttcggctactcggtcgccctccatcggcagacagagcggcagcagcgctacctgctcctggctggtgccccccgggagctcgctgtgcccgatggctacaccaaccggactggtgctgtgtacctgtgcccactcactgcccacaaggatgactgtgagcggatgaacatcacagtgaaaaatgaccctggccatcacattattgaggacatgtggcttggagtgactgtggccagccagggccctgcaggcagagttctggtctgtgcccaccgctacacccaggtgctgtggtcagggtcagaagaccagcggcgcatggtgggcaagtgctacgtgcgaggcaatgacctagagctggactccagtgatgactggcagacctaccacaacgagatgtgcaatagcaacacagactacctggagacgggcatgtgccagctgggcaccagcggtggcttcacccagaacactgtgtacttcggcgcccccggtgcctacaactggaaaggaaacagctacatgattcagcgcaaggagtgggacttatctgagtatagttacaaggacccagaggaccaaggaaacctctatattgggtacacgatgcaggtaggcagcttcatcctgcaccccaaaaacatcaccattgtgacaggtgccccacggcaccgacatatgggcgcggtgttcttgctgagccaggaggcaggcggagacctgcggaggaggcaggtgctggagggctcgcaggtgggcgcctattttggcagcgccattgccctggcagacctgaacaatgatgggtggcaggacctcctggtgggcgccccctactacttcgagaggaaagaggaagtagggggtgccatctatgtcttcatgaaccaggcgggaacctccttccctgctcacccctcactccttcttcatggccccagtggctctgcctttggtttatctgtggccagcattggtgacatcaaccaggatggatttcaggatattgctgtgggagctccgtttgaaggcttgggcaaagtgtacatctatcacagtagctctaaggggctccttagacagccccagcaggtaatccatggagagaagctgggactgcctgggttggccaccttcggctattccctcagtgggcagatggatgtggatgagaacttctacccagaccttctagtgggaagcctgtcagaccacattgtgctgctgcgggcccggcccgtcatcaacatcgtccacaagaccttggtgcccaggccagctgtgctggaccctgcactttgcacggccacctcttgtgtgcaagtggagctgtgctttgcttacaaccagagtgccgggaaccccaactacaggcgaaacatcaccctggcctacactctggaggctgacagggaccgccggccgccccggctccgctttgccggcagtgagtccgctgtcttccacggcttcttctccatgcccgagatgcgctgccagaagctggagctgctcctgatggacaacctccgtgacaaactccgccccatcatcatctccatgaactactctttacctttgcggatgcccgatcgcccccggctggggctgcggtccctggacgcctacccgatcctcaaccaggcacaggctctggagaaccacactgaggtccagttccagaaggagtgcgggcctgacaacaagtgtgagagcaacttgcagatgcgggcagccttcgtgtcagagcagcagcagaagctgagcaggctccagtacagcagagacgtccggaaattgctcctgagcatcaacgtgacgaacacccggacctcggagcgctccggggaggacgcccacgaggcgctgctcaccctggtggtgcctcccgccctgctgctgtcctcagtgcgcccccccggggcctgccaagctaatgagaccatcttttgcgagctggggaaccccttcaaacggaaccagaggatggagctgctcatcgcctttgaggtcatcggggtgaccctgcacacaagggaccttcaggtgcagctgcagctctccacgtcgagtcaccaggacaacctgtggcccatgatcctcactctgctggtggactatacactccagacctcgcttagcatggtaaatcaccggctacaaagcttctttggggggacagtgatgggtgagtctggcatgaaaactgtggaggatgtaggaagccccctcaagtatgaattccaggtgggcccaatgggggaggggctggtgggcctggggaccctggtcctaggtctggagtggccctacgaagtcagcaatggcaagtggctgctgtatcccacggagatcaccgtccatggcaatgggtcctggccctgccgaccacctggagaccttatcaaccctctcaacctcactctttctgaccctggggacaggccatcatccccacagcgcaggcggcgacagctggatccagggggaggccagggccccccacctgtcactctggctgctgccaaaaaagccaagtctgagactgtgctgacctgtgccacagggcgtgcccactgtgtgtggctagagtgccccatccctgatgcccccgttgtcaccaacgtgactgtgaaggcacgagtgtggaacagcaccttcatcgaggattacagagactttgaccgagtccgggtaaatggctgggctaccctattcctccgaaccagcatccccaccatcaacatggagaacaagaccacgtggttctctgtggacattgactcggagctggtggaggagctgccggccgaaatcgagctgtggctggtgctggtggccgtgggtgcagggctgctgctgctggggctgatcatcctcctgctgtggaagtgcggcttcttcaagcgagcccgcactcgcgccctgtatgaagctaagaggcagaaggcggagatgaagagccagccgtcagagacagagaggctgaccgacgactactgagggggcagccccccgcccccggcccacctggtgtgacttctttaagcggacccgctattatcagatcatgcccaagtaccacgcagtgcggatccgggaggaggagcgctacccacctccagggagcaccctgcccaccaagaagcactgggtgaccagctggcagactcgggaccaatactactgacgtcctccctgatcccaccccctcctcccccagtgtcccctttcttcctatttatcataagttatgcctctgacagtccacaggggccaccacctttggctggtagcagcaggctcaggcacatacacctcgtcaagagcatgcacatgctgtctggccctggggatcttcccacaggagggccagcgctgtggaccttacaacgccgagtgcactgcattcctgtgccctagatgcacgtggggcccactgctcgtggactgtgctggtgcatcacggatggtgcatgggctcgccgtgtctcagcctctgccagcgccaaaacaagccaaagagcctcccaccagagccgggaggaaaaggcccctgcaatgtggtgacacctccccctttcacactggatccatcttgagccacagtcactggattgactttgctgtcaaaactactgacagggagcagcccccgggccgctggctggtgggcccccaatgacacccatgccagagaggtggggatcctgcctaaggttgtctacgggggcacttggaggacctggcgtgctcagacccaacagcaaaggaactagaaagaaggacccagaacggcttgctttcctgcatctctgtgaagcctctctccttggccacagactgaactcgcagggaatgcagcaggaaggaacaaagacaggcaaacggcaacgtagcctgggctcactgtgctggggcacggcgggatcctccacagagaggaggggaccaattctggacagacagatgttgggaggatacagaggagatgccacttctcactcaccactaccagccagcctcagaaggccccagagagaccctgcaagaccacggagggagcgacacttgaatgtagaataggcagggggccctgccccaccccatccagccagaccccacgctgaccatgcgtcaggggcctagaggtggagttcttagctatccttggctttcagagccagcctggctctgccccctcccccatgggctgtgtcctaaggcccatttgagaagctgaggctagttccagaaaacctctcctgacccctgcctgttggcaggcccactccccagccccagccccttccatggtactgtagcaggggaattccctccccctccttgtgccttctttgtatataggcttctcacggcgaccaataaacagctcccagtttgta

SEQ ID NO: 58 - DNA, 2627 bp, Homo sapiens
acgcggggctcctgcagcatggctgtcagcaggaaggactggtccgcgctgtccagccttgcccggcagaggactctggaggatgaggaggaacaggagcgcgagcgcaggcggcggcaccgcaacctgagctccaccacggacgatgaggctcccaggctcagccagaatggagaccggcaggcctctgcttctgagagactaccgagcgtggaagaagcagaggtgcccaagccactgcccccagcctccaaagatgaggacgaggacatccagagcatcctcagaacacggcaggagcggaggcagaggcggcaggtggtggaggctgcacaggcccccatccaggagaggctggaggcagaggaggggaggaacagcttgagccctgtgcaggccacacagaaacccctagtctccaagaaggaactggaaatcccacctcgccggagactgagtcgggaacagcggggcccctgggccctggaggaggagagcttggtgggcagggagccagaagagaggaagaaaggggttccagaaaagtccccagtcttggagaagtcctccatgccaaagaagacggcacctgaaaagagcctggtctccgataaaacctccatctctgagaaggtgctggcctcagagaagacatctctatcagagaagatagcagtgtcagagaaaagaaacagctcagagaagaagtctgttctagaaaaaaccagtgtctctgagaagtcgctggccccagggatggcactgggctcaggaaggaggctggtgtctgagaaagcttccatctttgagaaggcactggcctcagagaagagcccaactgcagatgctaagccggccccaaagagggccacagcctcagagcagcccctggcgcaggagccgccagcctctgggggaagcccagccaccaccaaggagcagagaggaagggccctccctgggaagaacctgccctctttggcaaagcagggggcttcagaccctccgactgtggcctcccgcctcccacccgtcacactccaggtgaaaatccccagcaaggaggaagaggcagatatgtcctcacccacacagcgaacctacagcagctccctcaaacgctccagccccaggaccatctcctttcggatgaaacccaagaaagaaaactcggaaacaaccctaactcgcagtgccagcatgaagctcccagacaacacagtgaagttgggagagaagctggagagataccacacggccatacggagatcagaatctgtcaagtctcggggtctgccttgcactgagttattcgtggctcctgtgggtgtagccagcaagcgccacctctttgagaaggaactggcgggccagagccgagcagaaccagcctccagccggaaggagaacttgaggctctcaggggttgtgacatcaaggctcaacctgtggatcagcaggacccaggaatctggagatcaggacccccaggaggcacagaaagcatcatctgcaaccgagaggactcagtggggacagaaatctgactcctcgctggacgctgaggtgtgacaagccccgccaagacagacctgcaagtcttcgtctcaagggacctccctcatgccaggcccctgcctctcacagcagcaccctttcctctcattgtccctgttccctttttgcctgtggatctgtttggccagggtccctggggtcaggaatatttgcaagactcagccagctccttcccagcccagcctcttggggctgggactttctcaccctgcggcaggcacaacagatgctgggacccagtctctgcccaggtcacagcacaagtgcacatcagcactatggggcctatgtcctgcccagagacctctgctccttcctgctcacatccacagtcagggcacggcgcccctcaagaactccagagtcacctgtctcatcggctcccagcaagtgcctctttgtctatgatgtcccccttctctgaggcctggacccacccatctttgtccctggggcctgctcccagccactgaggcccgctctggccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcatttactctcaggtgtaagagactgatgagaccttagaagcgaattcctctctggaggccttgctttctagcagaggtcacctgaagtgtgtgaggaggatcatcattttcctcatcccccctcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaaccccttaaagctgtggtttacaacttttcaaaaatttaaatcattagaactctc

SEQ ID NO: 59 - DNA, 1336 bp, Homo sapiens
cccctcctccctccttgcagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgtgaaaaaaaaaaaaaaaaaaaa

SEQ ID NO: 60 - DNA, 2041 bp, Homo sapiens
tgagagaatcattaacttaatttgactatctggtttgtggatgcgtttactctcatgtaagtcaacaacatcctgggattgggacacactttctgggcactgctggccagtcccaaaatggaacataaggaagtggttcttctacttctgttatttctgaaatcagcaccgactgagacagggccttctgtgcaggagtgctaccacagtaatggacagagttatcgaggcacatacttcaccactgtcacaggaagaacctgccaagcttggtcatctatgacgccacaccagcacagtagaaccccagaaaagtacccaaatgatggcttgatctcgaactactgcaggaatccggattgttcggcaggcccttggtgttatacgacggatcccaatgtcaggtgggagtactgcaacctgacacggtgctcagacgatgaagggactgtgttcgtgcctctgactgttatcccagttccaagcctagaggattcattcatacaagtggcttgatctccaactactgcaggaatccggattgttcggcaggcccttggtgttatacaacggatcccaaagtcaggtgggagtactgcaacctgacaggatgctcagacaagaatagggctgtggccgcgcctctgactattatcccggttccaagacgagaggatacttccaaacaagcactgattgatccaaggccttcaatgtaggagtgctaccatggaaatggacagagttatcgaggcacatacttcaccaccgtcacaggaagcacttgccaagcttggtcatctatgacaccacaccagcacagtaggacctcagaaaagtacccaaatgctgacttgatcatgaactactgcaggaatccagatcctgtggaaggcccttggtgttacacgatggatcccaaagtcagatgggagtactgcaacctgacacgatgctcagacacagaagggactgcagtcgtgcctctgactgttatcccggttccaagcctagaggatccttccaaaccagcaccaacagagccaaggccttgggagcagcagtgctaccacggtaatggacagagttatcgaggcacatacttcaccactgtcacaggaagaacctgccaagcttggtcatctatgacgccacatcagcacatggcctgaccaggaactactgcaggaatccagattctgggaaacaaccctggtgttacacaactgatccgtgtgtgaggtgggagtactgcaacctgacacaatgctcagaaacagaatcagtgtcctagagactcccactgttgttccagttccaagcatggaggctcattctgaagcagcaccaactgagcaaacccctgtggtccggcagtgctaccatggtaatggacagagttatcaaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccacagaccccagcgtcaggtgggagtactgcaacctgacgcgatgctcagacagaagggactgtggtcgctcctccgactgttatccaggttccaagcctagaggctccttccgaacaagtaaaaagtctgtatccagacatctatgtgcttggacaacgggatgaaaagacatgaaaaaccacactgatgcagaagcctttagtgctgcacgggagctcgagtgttggttgagggtctgccatgaccaaggaagcctcaatgccgtccctgggaaagccagagctgtgatttttggcacaacttgcgagtgtagtgactttaggactggcgcaaaacctccagggtgctcaacttaaccactcaccttgttctaaaataggttatttcagtgtcccagtcaaattcctattctaacatgctgtcaactatgtgattctttccaagccaataaacatttccagtaatttcttaaaa

SEQ ID NO: 61 - DNA, 6431 bp, Homo sapiens
gtaagtcaacaatgtcctgggattgggacacactttctgggcactgctggccagtcccaaaatggaacataaggaagtggttcttctacttcttttatttctgaaatcagcagcacctgagcaaagccatgtggtccaggattgctaccatggtgatggacagagttatcgaggcacgtactccaccactgtcacaggaaggacctgccaagcttggtcatctatgacaccacatcaacataataggaccacagaaaactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcaaaggcctggggtgcaggagtgctaccatggtaatggacagagttatcgaggcacatactccaccactgtcacaggaagaacctgccaagcttggtcatctatgacaccacactcgcatagtcggaccccagaatactacccaaatgctggcttgatcatgaactactgcaggaatccagatgctgtggcagctccttattgttatacgagggatcccggtgtcaggtgggagtactgcaacctgacgcaatgctcagacgcagaagggactgccgtcgcgcctccgactgttaccccggttccaagcctagaggctccttccgaacaagcaccgactgagcagaggcctggggtgcaggagtgctaccacggtaatggacagagttatcgaggcacatactccaccactgtcactggaagaacctgccaagcttggtcatctatgacaccacactcgcatagtcggaccccagaatactacccaaatgctggcttgatcatgaactactgcaggaatccagatcctgtggcagccccttattgttatacgagggatcccagtgtcaggtgggagtactgcaacctgacacaatgctcagacgcagaagggactgccgtcgcgcctccaactattaccccgattccaagcctagaggctccttctgaacaagcaccaactgagcaaaggcctggggtgcaggagtgctaccacggaaatggacagagttatcaaggcacatacttcattactgtcacaggaagaacctgccaagcttggtcatctatgacaccacactcgcatagtcggaccccagcatactacccaaatgctggcttgatcaagaactactgccgaaatccagatcctgtggcagccccttggtgttatacaacagatcccagtgtcaggtgggagtactgcaacctgacacgatgctcagatgcagaatggactgccttcgtccctccgaatgttattctggctccaagcctagaggctttttttgaacaagcactgactgaggaaacccccggggtacaggactgctactaccattatggacagagttaccgaggcacatactccaccactgtcacaggaagaacttgccaagcttggtcatctatgacaccacaccagcatagtcggaccccagaaaactacccaaatgctggcctgaccaggaactactgcaggaatccagatgctgagattcgcccttggtgttacaccatggatcccagtgtcaggtgggagtactgcaacctgacacaatgcctggtgacagaatcaagtgtccttgcaactctcacggtggtcccagatccaagcacagaggcttcttctgaagaagcaccaacggagcaaagccccggggtccaggattgctaccatggtgatggacagagttatcgaggctcattctctaccactgtcacaggaaggacatgtcagtcttggtcctctatgacaccacactggcatcagaggacaacagaatattatccaaatggtggcctgaccaggaactactgcaggaatccagatgctgagattagtccttggtgttataccatggatcccaatgtcagatgggagtactgcaacctgacacaatgtccagtgacagaatcaagtgtccttgcgacgtccacggctgtttctgaacaagcaccaacggagcaaagccccacagtccaggactgctaccatggtgatggacagagttatcgaggctcattctccaccactgttacaggaaggacatgtcagtcttggtcctctatgacaccacactggcatcagagaaccacagaatactacccaaatggtggcctgaccaggaactactgcaggaatccagatgctgagattcgcccttggtgttataccatggatcccagtgtcagatgggagtactgcaacctgacgcaatgtccagtgatggaatcaactctcctcacaactcccacggtggtcccagttccaagcacagagcttccttctgaagaagcaccaactgaaaacagcactggggtccaggactgctaccgaggtgatggacagagttatcgaggcacactctccaccactatcacaggaagaacatgtcagtcttggtcgtctatgacaccacattggcatcggaggatcccattatactatccaaatgctggcctgaccaggaactactgcaggaatccagatgctgagattcgcccttggtgttacaccatggatcccagtgtcaggtgggagtactgcaacctgacacgatgtccagtgacagaatcgagtgtcctcacaactcccacagtggccccggttccaagcacagaggctccttctgaacaagcaccacctgagaaaagccctgtggtccaggattgctaccatggtgatggacggagttatcgaggcatatcctccaccactgtcacaggaaggacctgtcaatcttggtcatctatgataccacactggcatcagaggaccccagaaaactacccaaatgctggcctgaccgagaactactgcaggaatccagattctgggaaacaaccctggtgttacacaaccgatccgtgtgtgaggtgggagtactgcaatctgacacaatgctcagaaacagaatcaggtgtcctagagactcccactgttgttccagttccaagcatggaggctcattctgaagcagcaccaactgagcaaacccctgtggtccggcagtgctaccatggtaatggccagagttatcgaggcacattctccaccactgtcacaggaaggacatgtcaatcttggtcatccatgacaccacaccggcatcagaggaccccagaaaactacccaaatgatggcctgacaatgaactactgcaggaatccagatgccgatacaggcccttggtgttttaccatggaccccagcatcaggtgggagtactgcaacctgacgcgatgctcagacacagaagggactgtggtcgctcctccgactgtcatccaggttccaagcctagggcctccttctgaacaagactgtatgtttgggaatgggaaaggataccggggcaagaaggcaaccactgttactgggacgccatgccaggaatgggctgcccaggagccccatagacacagcacgttcattccagggacaaataaatgggcaggtctggaaaaaaattactgccgtaaccctgatggtgacatcaatggtccctggtgctacacaatgaatccaagaaaactttttgactactgtgatatccctctctgtgcatcctcttcatttgattgtgggaagcctcaagtggagccgaagaaatgtcctggaagcattgtaggggggtgtgtggcccacccacattcctggccctggcaagtcagtctcagaacaaggtttggaaagcacttctgtggaggcaccttaatatccccagagtgggtgctgactgctgctcactgcttgaagaagtcctcaaggccttcatcctacaaggtcatcctgggtgcacaccaagaagtgaacctcgaatctcatgttcaggaaatagaagtgtctaggctgttcttggagcccacacaagcagatattgccttgctaaagctaagcaggcctgccgtcatcactgacaaagtaatgccagcttgtctgccatccccagactacatggtcaccgccaggactgaatgttacatcactggctggggagaaacccaaggtacctttgggactggccttctcaaggaagcccagctccttgttattgagaatgaagtgtgcaatcactataagtatatttgtgctgagcatttggccagaggcactgacagttgccagggtgacagtggagggcctctggtttgcttcgagaaggacaaatacattttacaaggagtcacttcttggggtcttggctgtgcacgccccaataagcctggtgtctatgctcgtgtttcaaggtttgttacttggattgagggaatgatgagaaataattaattggacgggagacagagtgaagcatcaacctacttagaagctgaaacgtgggtaaggatttagcatgctggaaataatagacagcaatcaaacgaagacactgttcccagctaccagctatgccaaaccttggcatttttggtatttttgtgtataagcttttaaggtctgactgacaaattctgtattaaggtgtcatagctatgacatttgttaaaaataaactctgcacttattttgatttgaa

SEQ ID NO: 62 - DNA, 749 bp, Homo sapiens
actgctcccagacgacatcagagatgaggacagcattgctgctccttgcagccctggctgtggctacagggccagcccttaccctgcgctgccacgtgtgcaccagctccagcaactgcaagcattctgtggtctgcccggccagctctcgcttctgcaagaccacgaacacagtggagcctctgagggggaatctggtgaagaaggactgtgcggagtcgtgcacacccagctacaccctgcaaggccaggtcagcagcggcaccagctccacccagtgctgccaggaggacctgtgcaatgagaagctgcacaacgctgcacccacccgcaccgccctcgcccacagtgccctcagcctggggctggccctgagcctcctggccgtcatcttagcccccagcctgtgaccttccccccagggaaggcccctcatgcctttccttccctttctctggggattccacacctctcttccccagccgcaacgggggtgccaggagccccaggctgagggcttccccgaaagtctgggaccaggtccaggtgggcatggaatgctgatgacttggagcaggccccacagaccccacagaggatgaagccaccccacagaggatgcagcccccagctgcatggaaggtggaggacagaagccctgtggatccccggatttcacactccttctgttttgttgccgtttatttttgtactcaaatctctacatggagataaatgatttaaaccag

SEQ ID NO: 63 - DNA, 3261 bp, Homo sapiens
ggaaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcggcgacagcttcggacccacatggtggacctgctggttccgggtggagctgaccatcccagaggcatgggtgggccaggaagttcacctttgctgggaaagtgatggagaaggtctggtgtggcgtgatggagaacctgtccagggtttaaccaaagagggtgagaagaccagctatgtcctgactgacaggctgggggaaagagacccccgaagcctcactctctatgtggaagtagcctgcaatgggctcctgggggccgggaagggaagcatgattgcagcccctgaccctgagaagatgttccagctgagccgggctgagctagctgtgttccaccgggatgtccacatgctcctggtggatctggagctgctgctgggcatagccaagggcctcgggaaggacaaccagcgcagcttccaggccctgtacacagccaatcagatggtgaacgtgtgtgaccctgcccagcccgagaccttcccagtggcccaggccctggcctccaggttctttggccaacatgggggtgaaagccaacacaccattcatgccacagggcactgccacattgatacagcctggctttggcccttcaaagagactgtgaggaaatgtgcccggagctgggtgaccgccctgcagctcatggagcggaaccctgagttcatctttgcctgctcccaggcgcagcagctggaatgggtgaagagccgctaccctggcctgtactcccgcatccaggagtttgcgtgccgtgggcagtttgtgcctgtggggggcacctgggtggagatggatgggaacctgcccagtggagaggccatggtgaggcagtttttgcagggccagaacttctttctgcaggagtttgggaagatgtgctctgagttctggctgccggacacctttggctactcagcacagctcccccagatcatgcacggctgtggcatcaggcgctttctcacccagaaattgagctggaatttggtgaactccttcccacaccatacatttttctgggagggcctggatggctcccgtgtactggtccacttcccacctggcgactcctatgggatgcagggcagcgtggaggaggtgctgaagaccgtggccaacaaccgggacaaggggcgggccaaccacagtgccttcctctttggctttggggatgggggtggtggccccacccagaccatgctggaccgcctgaagcgcctgagcaatacggatgggctgcccagggtgcagctatcttctccaagacagctcttctcagcactggagagtgactcagagcagctgtgcacgtgggttggggagctcttcttggagctgcacaatggcacatacaccacccatgcccagatcaagaaggggaaccgggaatgtgagcggatcctgcacgacgtggagctgctcagtagcctggccctggcccgcagtgcccagttcctatacccagcagcccagctgcagcacctctggaggctccttcttctgaaccagttccatgatgtggtgactggaagctgcatccagatggtggcagaggaagccatgtgccattatgaagacatccgttcccatggcaatacactgctcagcgctgcagccgcagccctgtgtgctggggagccaggtcctgagggcctcctcatcgtcaacacactgccctggaagcggatcgaagtgatggccctgcccaaaccgggcggggcccacagcctagccctggtgacagtgcccagcatgggctatgctcctgttcctccccccacctcactgcagcccctgctgccccagcagcctgtgttcgtagtgcaagagactgatggctccgtgactctggacaatggcatcatccgagtgaagctggacccaactggtcgcctgacgtccttggtcctggtggcctctggcagggaggccattgctgagggcgccgtggggaaccagtttgtgctatttgatgatgtccccttgtactgggatgcatgggacgtcatggactaccacctggagacacggaagcctgtgctgggccaggcagggaccctggcagtgggcaccgagggcggcctgcggggcagcgcctggttcttgctacagatcagccccaacagtcggcttagccaggaggttgtgctggacgttggctgcccctatgtccgcttccacaccgaggtacactggcatgaggcccacaagttcctgaaggtggagttccctgctcgcgtgcggagttcccaggccacctatgagatccagtttgggcacctgcagcgacctacccactacaatacctcttgggactgggctcgatttgaggtgtgggcccatcgctggatggatctgtcagaacacggctttgggctggccctgctcaacgactgcaagtatggcgcgtcagtgcgaggcagcatcctcagcctctcgctcttgcgggcgcctaaagccccggacgctactgctgacacggggcgccacgagttcacctatgcactgatgccgcacaagggctctttccaggatgctggcgttatccaagctgcctacagcctaaacttccccctgttggctctgccagcccccagcccagcgcccgccacctcctggagtgcgttttccgtgtcttcacccgcggtcgtattggagaccgtcaagcaggcggagagcagcccccagcgccgctcgctggtcctgaggctgtatgaggcccacggcagccacgtggactgctggctgcacttgtcgctgccggttcaggaggccatcctctgcgatctcttggagcgaccagaccctgctggccacttgacccttcgggacaaccgcctgaagctcaccttttctcccttccaagtgctgtccctgttgctcgtgcttcagcctccgccacactgagtccctggggctggggttttgtttgtagaaggctctggggactcctaatttctgcttccccagcctaaagcagggatcagtcttttcttgtggaataaatccttggatcgggaa

SEQ ID NO: 64 - DNA, 5151 bp, Homo sapiens
ctccctccccagcccctccaccgcctccctccgccgccgcttgggccggctccgcgccccctccgcggcccccgcccgcccgcctgcccgccgcccccatggcgcccggggtccccgctgcacggggccactaggaccctcggcgtcccttcccctcccccgccctgccccctctcccgccgcgcggacccgggcgttctcggcgcccagcttttgagctcgcgtccccaggccggcggggggggaggggaagagaggggaccctgggacccccgccccccccacccggccgcccctgccccccgggacccggagaagatgtcttcgcggacggtgctggccccgggcaacgatcggaactcggacacgcatggcaccttgggcagtggccgctcctcggacaaaggcccgtcctggtccagccgctcactgggtgcccgttgccggaactccatcgcctcctgtcccgaggagcagccccacgtgggcaactaccgcctgctgaggaccattgggaagggcaactttgccaaagtcaagctggctcggcacatcctcactggtcgggaggttgccatcaagattatcgacaaaacccagctgaatcccagcagcctgcagaagctgttccgagaagtccgcatcatgaagggcctaaaccaccccaacatcgtgaagctctttgaggtgattgagactgagaagacgctgtacctggtgatggagtacgcaagtgctggagaagtgtttgactacctcgtgtcgcatggccgcatgaaggagaaggaagctcgagccaagttccgacagattgtttcggctgtgcactattgtcaccagaaaaatattgtacacagggacctgaaggctgagaacctcttgctggatgccgaggccaacatcaagattgctgactttggcttcagcaacgagttcacgctgggatcgaagctggacacgttctgcgggagccccccatatgccgccccggagctgtttcagggcaagaagtacgacgggccggaggtggacatctggagcctgggagtcatcctgtacaccctcgtcagcggctccctgcccttcgacgggcacaacctcaaggagctgcgggagcgagtactcagagggaagtaccgggtccctttctacatgtcaacagactgtgagagcatcctgcggagatttttggtgctgaacccagctaaacgctgtactctcgagcaaatcatgaaagacaaatggatcaacatcggctatgagggtgaggagttgaagccatacacagagcccgaggaggacttcggggacaccaagagaattgaggtgatggtgggtatgggctacacacgggaagaaatcaaagagtccttgaccagccagaagtacaacgaagtgaccgccacctacctcctgctgggcaggaagactgaggagggtggggaccggggcgccccagggctggccctggcacgggtgcgggcgcccagcgacaccaccaacggaacaagttccagcaaaggcaccagccacagcaaagggcagcggagttcctcttccacctaccaccgccagcgcaggcatagcgatttctgtggcccatcccctgcacccctgcaccccaaacgcagcccgacgagcacgggggaggcggagctgaaggaggagcggctgccaggccggaaggcgagctgcagcaccgcggggagtgggagtcgagggctgcccccctccagccccatggtcagcagcgcccacaaccccaacaaggcagagatcccagagcggcggaaggacagcacgagcacccccaacaacctccctcctagcatgatgacccgcagaaacacctacgtttgcacagaacgcccgggggctgagcgcccgtcactgttgccaaatgggaaagaaaacagctcaggcaccccacgggtgccccctgcctccccctccagtcacagcctggcacccccatcaggggagcggagccgcctggcacgtggttccaccatccgcagcaccttccatggtggccaggtccgggaccggcgggcagggggtgggggtggtgggggtgtgcagaatgggccccctgcctctcccacactggcccatgaggctgcacccctgcccgccgggcggccccgccccaccaccaacctcttcaccaagctgacctccaaactgacccgaagggtcgcagacgaacctgagagaatcgggggacctgaggtcacaagttgccatctaccttgggatcaaacggaaaccgccccccggctgctccgattcccctggagtgtgaagctgaccagctcgcgccctcctgaggccctgatggcagctctgcgccaggccacagcagccgcccgctgccgctgccgccagccacagccgttcctgctggcctgcctgcacgggggtgcgggcgggcccgagcccctgtcccacttcgaagtggaggtctgccagctgccccggccaggcttgcggggagttctcttccgccgtgtggcgggcaccgccctggccttccgcaccctcgtcacccgcatctccaacgacctcgagctctgagccaccacggtcccagggcccttactcttcctctcccttgtcgccttcacttctacaggaggggaaggggccagggaggggattctccctttatcatcacctcagtttccctgaattatatttgggggcaaagattgtcccctctgctgttctctggggccgctcagcacagaagaaggatgagggggctcagcggggggagctggcaccttcctggagcctccagccagtcctgtcctccctcgccctaccaagagggcacctgaggagactttggggacagggcaggggcagggagggaaactgaggaaatcttccattcctcccaacagctcaaaattaggccttgggcaggggcagggagagctgctgagcctaaagactggagaatctgggggactgggagtgggggtcagagaggcagattccttcccctcccgtcccctcacgctcaaacccccacttcctgccccaggctggcgcggggcactttgtacaaatccttgtaaataccccacaccctcccctctgcaaaggtctcttgaggagctgccgctgtcacctacggtttttaagttattacaccccgaccctcctcctgtcagccccctcacctgcagcctgttgcccaataaatttaagagagtccccccctccccaatgctgaccctaggattttccttccctgccctcacctgcaaatgagttaaagaagaggcgtgggaatccaggcagtggtttttcctttcggagcctcggttttctcatctgcagaatgggagcggtgggggtgggaaggtaaggatggtcgtggaagaaggcaggatggaactcggcctcatccccgaggccccagttcctatatcgggccccccattcatccactcacactcccagccaccatgttacactggactctaagccacttcttactccagtagtaaatttattcaataaacaatcattgacccatgcctactccatgccaggcccagtgctggacacagagacatgaagctctgtctgtgggagacagggattctgacacagacaccggacaaaccattgtcttggggagcccagaagagaaagtgggcagggtggggtcattggggaagatgctctagaggaattaatgctggaatggggtgttgaaggatgagtaggagttagttaggcattgagtttgccctgggcaaaagcccagaagtgggagtatgtggtatatcttcagagaactgggtaatttcagtgtggctgctgtgttgggcatggatggagaatcagcaagagaaatgctgtattaggactaataatccatctacgctgcttaagcaaaaaggtatttgttggtttatgttacttaatagtccaggggcacctggcttcaggtaggtttgatccaggcatcaggccattgcatctattttttcagtgtaagttgaattctagtaatttttatcaagtaagggctcctttcctggtggcacagatgacttcagcagttagaagtttctatccctccagctttctgcagcagaaagaccctcattgtcagtttcccagcaaaagtcccagggcagactctcattggcccaaatgggccatgtgattttctctaaaccaatcactgtgactctagagtggccagactcagagctgcacttagtaggggttcctcaaaggaaggtcaagtgtcatgagcaggagaaaaggcatgggagctggacagattatagtggttgaagtctgtgcagtacagaagggcggagcttattcacacagcacctttggggccaaaatgaataagctggactttctccccatggcactggggaaccatggaagttcagggaacttcagggaagaggcttggtcaattcctgagagcatcctctgtgctggggacacagtggtaatcaagacagccccaacactgccctcatagagctcacagtccaatggaggaggcagatgtgtcctcaggcagcgactgggcagggctggtataggggagtccagaggtgatgcctgcctcagccagggagggcttcctggaggagaaggagccagctagacatggataggagtgcgttttaggcacagcaaatggcacatacaagggccagggagcaagagagaggacaggtcctcaacaaatggcatgtgactttgtaagtgtagaattgctgtgaggtatggggctaggggcgtcagtagggccttgaaggttatggacaggggcctgggctttcttccaagggcactgggggagccatggcaaggttgtaggtagggtagagatgggcgggtttgtgctatgtgcagggtggaagggagggaagttgacaggtcagaagatcaggaaagaggtcggggctggacagatggggagagcgcagatagatttaagagagtcctgtgaggcaaagtgggcaggacctggtaacaggtgtctggactgtggctttggctggctcagaaggtccccactggcgtgtgtggtctatgtagcctctgggtgtggagctgggatcttcaactggggacagtacagtaaagaacatcacagca

SEQ ID NO: 65 - DNA, 2294 bp, Homo sapiens
agtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaag

SEQ ID NO: 66 - DNA, 7637 bp, Homo sapiens
gagtcattgcagttttcagtagaggtgtacttctgagaagtggcttcttgggtcttcatgcagccatggatctggataaaccatctgtttggggctcattaaaacagcggaccaggccattgttgatcaacttgagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtgttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacagtttgactttcactacttctctgacaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggtatttttgatcactgtctggaattttgaactatatatgatccccttggcattgttgctgatctttgtctacaatttcatcagacctgtgaaaggcaaggtcagcagcatccaggacagccaggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctagggcacacaccgactttggacagcagcacccaatattgtgtttggttgagtagaccaatgttatggctgtttcagtggtacccaaggtgtccttctgaaatgcatgccctgtggcaccctctgtatacttcctcctccttcacgtgcacagacatacacacatgtgcacacaccctcatgcatgggtgtcctagttgcgtagagggtcagcccagcgaaaagcaacaaccccaagactgtgaaagactaacatccattctgaaataggagataacaaggctgccatggatctgaacaccaccttccttgagaacagccaggagcccacttggattcaagagtgactttgaacttgttttcacacctccaacagactctcattaagattcagttatttccgctccccagccccacactcctttcagattatcgttcatgggcgtaagtctcttctcagagttaacaagtctttggtagtcatcctctgtccaaatattgtatattattaaaaggcatttttaataattaccagaattagctcaaacctttagggatctttcagccatgattattaaggatatgtatgtgaatttttgggaaacctctcggtgctggatgccagcctacagcagggtccattgctggcaatggatggcccaggaaggtccctagagatcactcacttgaaaaatgagggtcccatgaaagtatttggttgccttctgatgccacttcttctcactttactttttgcttattttcaaaatattataaaatgtcaacatataatttcagaaaggcaggtgggggtaggggagaaatgaatgaataaattctctaggtatttagaaagataagaaactgaagaccgagagactaataaggctgcttacctaattattataatcatttcatttgcctgaatgttttaagcaggaagtagaaatactttggctgcccaaatgtatcttttgttcctcttagaagtaaaataagctacatacaataaaaatttatttcagaaccccatttctagaaaataccaccccagagtcctcatttgatagcatctgtctcctgcagacctcatcattccacagtatttccctgccatgtaaaaatcctgactttgtgcgtatataaaatgtatgcaattaagtctgtttaaatgatatttaagttttaaagactgtattttgttgacacatactttgtgcagtttttatgtatgtatgtattataaaaaaagttaaggttaaaaagatctcatttaatagtgagttcactatttttttttttttgtctctgggttgtaatttaataatcttcaaacaaaatgtttacgaaaaatgccaaagattctaaatcttatcatcccgtgtctgtttttcttcatgttgtatctcactgggttgctttctggctgagccagaattctgcatgatttgatttacttcaagttaatgaagctggctggaaaagagccttgcagaaattataaaagctccagtaaatctcgtagttgtacatacaatagatacccaagaacctcttttgttaaaccagttactcaatcttctgtgtaaacaatgcctcattgtcttgcttctaactatcatctagtttatcatagtctgtcattttgtaacgacctaagtcagacatttttaaacagacatgtgagatctgatcagtcatttgaatgaaaactttcagcagcaaaataaccccttatttatttaaaagtggaaccaatactttattgttgttcttttgctatagaatttcaaaatgaaattatttgcccgacaagaaggcatcattagttagacttgtttcctctgtagcccgattgaaattctcagtgttaagtttaggacccaaacaccagctgggacgtaagagcaggaccgaatcaaccttgaataaactgtatatagaaaacaattgttagttgattaagtagacattggatgtttgttagaaaggaatgttagttgtaagtgacatgttaagatttatacaattgtcaaaaacttttaggaaagattccagaatgcttttgataaaatttatcgattgtggattcacagtgtgataattaagtagggatgttgaagtcttgccaagttttcctggttcccttctcaaactttatcttcccatttctagccctgtctctctatcttacaggcatctacacctcagcaagtcagaaactaaacatcatctgtctctccctgtcttcagaaccccaaccctcataatctccttccagcttccttatttcccttaccaggactggcattttctgggcttggaatttctcggtcatcctctttttttttgttcctcgtgctgttgtcctcgtctcccaacccctaaagcctagtaggtccagtgtcaatgcattaaccacttctgttctgatttccaccacccaagtggaggccttcataacctctcagacgtcacggccatgatgccagttacattatgcctagttaatcttcattcagactggaaggacctgcccccagttgtttctttctgaatagattctactctccttcaacacttccaaagtctcctgccccaaagaggcttagttagtcctgtggctggatgtgactccaacttccttttttgtaccatcacatctttcatatctttctggcatctgccatacatcataagaggctttgaccactgtcctccactgaatagcccattacagctagcacctaatagttactcaggaaataaatacatgtttaacaggccaggtcgtagagattatttttctttctctgccttttcatgtgctgctttcagaacagagggctggattggatagattagtatgatctatcctggagattcatttcttgcattaagagcttattttgtgtgatattatttataatccctgactatgtcaattataaacttttaaattatgtcttatatttgaagttcttacctacatatcagaggaaaatataatgtttatttctaggtggtaaaacaatcttctggattcttttttctttacttgtaaattatcatttaacaagtctatattgaatgccgataattttctggaacaaaacagactacattcccttggtaaagccagacattaaacagatactttcaagcaacagcatgccatgctcagatttaagtttgaaaaatattctagctgcaatggatagcctagcaattttcaaagtttagagaagttattaatattagccctttgtagtactcctgataaatgaataacaccctggactttcaaatagtggcactgggaaaaaagtaagtagaattgagagatggtgaagagataaagtgagcaggacttaacaattgctggactatgggatgagggagcgtagagtcaaggatggctctcagtccctaggtctccaggtctaggaagatggtgttacctttcactaagggagagaactgtaagaactgctgtgagaggaccacaggagtccagttttagcgctgaatctcaggtgactgaaaagcatccaaataggaatgtcagcaaggtaatggaatatatagttctcagagaagtaacacactgtacttgagatgtacacaagttaaaggcaaacattgtatatgaaaagtgatcaaaactacatgcttcaagaaattaaaccttgaagaactcaacagttaatgtcatatatagaaaggcaagtcagttaagagtgtaaatagaaacgggtaaatacagaggagaaaaacagtaagcatggactgtcctagaattcagtggcagagcatactgcaagaaagctgatgtggtcaataatatcaaatgccgctgagatcacataagtacagaatcatgaccttaatggtttgacagtttggaagcaccctggcaacaagccatttcagtggaatggtagaaatggaaaccacgctgggttgagaagtgagtggatgtgaaaatatggggcctctgaatggaggtaacccttgaaaaattccactgtggagaagaaaggagagagagagggctggaatttggaatgaaaggagatatttgggattattttagtaagaaaacagaggtgtcatgacctcagtgtaaccctattagctgcaaaaaattcttcatgggcttgagatggagttagccatattcattattgaaaactatgttctgcacttatacattgttggttggagtgtaaattagttcaaccgctgtggaagacagggtgggtgtttcctcaaaaacctaaagacagaaataccatttgacccagcaatcccataactgggtatgtacccaaaggaatataaattgttctactataaaaacacatgcacacacatgttcactgcaacactatttacaatagcaaagacactggatcagtctaaatgcccatcattgatagaatggataaagaaaatgtggtagaggtacaccatggaatactatgcagccataaaaaagaatgagatcatgtccttttgcaggaacttggatacagctggaggccattatccttagcaaactaatgcagcaacagaaaaccaaataccacatgttctcatttataggtaggagttaaatgatgagaacacatggacatgtagaagggaacaaaatacactgggggctattggagggtgaagggtgaaaggaggaagaggatcaggaaaaataatgagtaccaggcttaatacatgggcgatgaaataatctgtatgacaagcctctctgacacagtttacctatgtaacaaacctgcacagttacccctgaactttaaaaaaaactatgttctatcaaaacctgcctctcatttatgtattaggaatcttgtgacaacggaacagttgaaaaattaaaataaaaattgcctgaaaatgcaaaaaaaaaaaaaaaaaa

SEQ ID NO: 67 - DNA, 1913 bp, Homo sapiens
agttggctcagctctccagagctcccggacagcagccggatcccggccggctcctggggcactaggacagacccccgcggctagcagcccggcctggggggcggaacactctcttcttgtcccgccccaccttcctccgggccgcaaccaccccagcccatcgctgggacgtggccgcgggtgccgagagcgctgccggcgccgtgggggccatcccggtcctggccccgacggcgccccaggacctgcgatagccaaacttttgcagagtttggacaggcaaaggaaaacgtgcagcccgcggatctccgggcctcagagagcagggagtcggggagactgaggccccgctccgagagcgcggaggaagcgcgcccagccggcttcctgtgggggctcgggcctcgggcgccccgcggacagacgtgtccggctcctggctgggccaagcccggcgcgggggaggggacccgcagaggggcgactgagaaggtccggggccgatgtaccaggtgagcggccagcgcccctctggctgcgacgcgccctatggagcccccagcgcagccccgggcccagcccagaccctatccctccttcctgggctggaggtagtaacaggatccactcaccctgcggaggcagcaccagaggagggctccctggaggaggcggcaacccccatgccccaaggcaatggccctggcatcccccagggcctggacagcactgacctcgacgtccccacagaagctgtgacatgccagcctcaggggaaccccttgggctgcaccccacttctgccgaatgactctggccacccctcagagctgggcggcaccagacgggcggggaatggtgccctgggtggccccaaggcccaccggaagttgcagacacacccatctctcgccagccagggcagcaagaagagtaagagcagcagcaaatccaccacctcccagatccccctccaggcacaggaagactgctgtgtccactgcatcctgtcctgcctgttctgcgagttcctgacgctgtgcaacatcgtcctggactgcgccacctgtggctcctgcagctcggaggactcgtgcctctgctgctgctgctgtggctctggcgagtgtgccgactgcgacctgccctgcgacctggactgcggcatcctggatgcctgctgcgagtccgcggactgcctggagatctgcatggagtgctgtgggctctgcttctcctcctgagcctctgtcgggggctaagccagcctggcgcccctgcagattccagcagggtccctctgagtggggccaggcccaggactgtcacacaaggcttgagaagccccctctccctggtcctctcctacccacccatgtcctctcagaaccccagccttgaaaatagtggggggcactcagaggggccacctcctcagccgtgggtggtgggcccatggcagagaagcctgaactctttactgggttaccaggttcatacattgctgaggacctgacaggacaacctaggggcagggctggggtggggaccgcagggggcagccagggctggggaacactgtgaaagttacttggggagggtgggccggtggggccgtagctctctacctctccctgctcctggtgcctgcctctctcctccaccccaggcttagaggacagaaaaatgtgaagagacgccccacccaccctcagccagccctctccagtctcctttcctaggcttttttgggggcctaacccacgcagtgaccccagagggcagggctaggcgagagcctggggtggggcgggagggggaacagtatggaaaagactggaaggggaaaggaagggaagggagggagggtctgttctatctgttgctgtaaataaagatatttgtccatctca

SEQ ID NO: 68 - DNA, 2746 bp, Homo sapiens
agggccggccgccggcggccgaggcgatgagggtgttggtgcggcgctgttggggtcctccgctggctcatggcgccaggcgtgggaggccgagtccccagtggcgagcactggcccgactcggctgggaggactgccgggactccagagtccgcgagaagcctccctggcgggtgctcttcttcggcacggaccagttcgcccgcgaggcgctgcgggcgctgcacgccgccagggaaaacaaagaagaagagttaatcgacaaactggaggtggtcacaatgccttccccatcaccaaaaggactgccagtgaagcaatatgctgtgcagtctcagcttcccgtatatgagtggccggatgtgggatctggagaatatgatgttggagtagtggcttcgtttggccgacttttgaatgaggctcttattcttaaatttccctatggcatattgaatgttcatcccagttgcctcccgagatggcgtggcccagcccctgtaatccatacagtgcttcacggagacacagttactggagtaacaattatgcaaattagacctaaaaggtttgatgtaggcccaattctcaaacaagaaactgttcctgtgccacccaagagcactgcaaaggaattggaagcagtgttgtcaagactgggtgccaacatgctcatttcagttttgaaaaatttgcctgaaagtctgagcaatggaaggcagcagccaatggagggggcgacttacgcccctaagatttctgctggtaccagttgtataaaatgggaggaacaaacttcagaacaaatattcagactttaccgtgccattggaaatataattccgttgcagacgctctggatggcgaataccattaaacttctggatttggtagaagttaacagttcagtccttgctgatccaaaattaacgggacaggctcttattccaggatcagtaatataccacaaacagtcacaaatactattggtttattgcaaggatggttggattggtgttcgatcagtgatgctcaagaaatcactaacagctactgacttctacaatggatatttgcacccctggtaccagaaaaattcccaagctcaaccaagccaatgcagatttcagactctcagacttccaacaaagaagaagcagaaaaaaactgttgctatgcaacaatgcattgagtagttaggaagaagatggataaaaacctattacatatttgtaatttattaaaaaccttatttacaaggaattatctggacttttttttttttttttttttttgagacagagtctcactctgtcacccaggctggaatccagtggcactatctcagctcactgcaacctccgcctcccaggttcaagcaattctcctgcctcagcctcctgagtagctgggattacaggcacacgccaccacacgcagctaatttttgtatttttagtagagatggggtttcaccatgttggtcaggctggtctcgaactcctgaccttgtgatctgcccacctcagcctcccaaagtgctatgattacagacgtgagccaccgtgcctggcctggaattatctggactttcaaagaagatggcattattataagaagagaagattattgccgaaaagatggattgcctcactttccactttttatgtaacagtagttaaaaaacagctttttttttacttgaattacaaaaaagtttaaataaaacttgtatttatgatacgaaactcaaggagattatctttccttaagaacaagggcaaccctaactggtgtatgtatgtacctacatacatactgagaagaggttttttgtttttatttttatttttttgagacggagtcttgttctgtggcccaggctggagtgcagtggcgtgatgtcagctcactgcaagctccacctcccgggttcacaccattctcctgcctcagcctcccaagtagctgggactacaggcgtccgccaccatgcctggctaatttttttttttgtatttttagtagagatggggtttcactgtgttagccaggatggtcttgatctcctgacctcgtgatccacccgccttggcctcccaaagtgctgggattacagctgtgagccaccgtgcctggccgagaagaggtttttttaaaaacagtgcatctatttaattttttaaaaatcgtgtcaccactgacattttaggagtattgaatctgcattttttatttcctataagtagtaaatccagctctttacatttcactaccagctagatttaaccaagtagtaaacgtaggtaatatttaataatctctgccacattgatctgtactataaattaacattttacatccagattttatttttttttattaatttttttagagatggggtcttgctctctcacacagtctggagtccagtggcgtgaaacactgcttactgcatcttcaacctcctgggcttaagtgatcctccagcctcagcctcccaaagtggggccaccacgcctggctaattttctttcttagtttttaaaaaaaattttgtagagataggggtctcactatgttgcttaggctggtcttgaactcctgggcccaagcaatcctcctgccttggcctctcaaagtgctgggattacaagcatgaaccactgcacccggcccaggttttcttgaagtaggaacgtgctaacatttttcaacttacttgtgcaataaaggttattgagca

SEQ ID NO: 69 - DNA, 2928 bp, Homo sapiens
ctttctgccgccatcttggttccgcgttccctgcacaaaatgcccggcgaagccacagaaaccgtccctgctacagagcaggagttgccgcagccccaggctgagacagctgtgctacctatgtcttcagccttgagtgtcactgctgccttagggcagcctggacctaccctcccccctccttgctctcctgccccacaacagtgccctctctcagctgctaaccaggcttccccattcccttccccctctactattgcctcgacccctttagaagttccttttccccagtcatcctctggaacagccctacctttgggaactgcccctgaagccccaaccttcctaccaaacctaatagggcctcccatctccccagctgccttagctctagcctctcccatgatagctccaactctgaaagggaccccttcctcttcagctcccttagctctggttgccctggctccccactcagttcagaagagttctgcttttccacctaaccttcttacttcacctccttcagtggctgtagctgagtcagggtcagtgataactctgtcagctcccattgctccctcagaaccaaagactaatcttaataaagttccctctgaggtagtccctaatccaaaaggcacccccagccctccatgtatagtcagtactgttccttaccactgtgtgactcccatggcctctattcaatctggagtggcctcccttcctcagacaacacccacaactaccctagccatcgcttcccctcaagtcaaagataccaccatttcctcagttctgatttctccacaaaacccaggaagcctcagcctgaaggggcctgttagtccacctgctgccttatctctttcaactcagtctcttcctgtggtgacctcttctcaaaagactgcgggtcccaacacccccccagattttcccatttctctgggctctcatcttgcacctttacatcagagttcttttggttctgtccaacttttaggtcaaacaggtcctagtgctttgtcagaccctacagtgaagaccatttctgtagatcattcttccacaggggcctcttatccttctcagagatctgtaattcctccccttccttccagaaatgaggtagttcctgctactgtggctgcctttccagtggtggctccatctgttgacaaaggtccctctaccatctctagcataacctgcagcccttctggctccttaaatgtagctacctctttttcattatctcctacaacctctctcattctcaaaagctctcctaatgccacttatcattatcctttagtggcccaaatgcccgtttcttctgttggaaccaccccacttgtggtgactaacccctgtacaattgctgcagcacctactactacctttgaggtagctacttgtgtttctcctccaatgtcatcaggtcccataagtaacatagaaccaacttcccctgctgccttggttatggcacctgtggctcccaaagagccttctactcaagtagcaaccactctgaggataccagtctctcctcctctgccagaccctgaagacctcaaaaatctccccagttcagtattggttaaatttccaacacaaaaagacctccaaactgtacctgcctctcttgaaggagcccctttctctccagcccaagcaggactcaccaccaagaaagaccctactgtattaccgttagtccaggcagcccctaaaaattccccttctttccaaagtacatcctcttctccagagatacctctttctcctgaagccaccctagcaaagaaaagccttggggagcctctccctatagtggctgcatttcctttggaaagtgctgaccctgccggggtggctcccacaactgccaaagcagctgcctttgagaaggtccttcctaaacctgaatcagcatctgtctctgcagcaccctccccaccagtctctctgcctcttgctccctccccagttcccactctgcctcctaaacagcaatttctgccgtcctctcctgggctggtgttggaatcaccctctaaaccccttgcccctgctgatgaggatgagctgctgcctctgattcccccggaaccaatctctgggggagtgcctttccagtcggtcctcgtcaacatgcccacccctaaatctgctggaatccctgtcccaaccccctctgccaagcaacctgttacgaagaacaacaaggggtctggaacagaatctgacagtgatgaatcagtaccagagcttgaagaacaggattccacccaggcaaccacacaacaagcccagctggcggcagcagctgaaattgatgaagaaccagtcagtaaagcaaaacagagtcggagtgaaaagaaggcacggaaggctatgtccaaactgggtcttcggcaggttacaggagttactagagtcactatccggaaatctaagaatatcctctttgtcatcacaaaaccagatgtctacaagagccctgcttcagatacttacatagtttttggggaagccaagatcgaagatttatcccagcaagcacaactagcagctgctgagaaattcaaagttcaaggtgaagctgtctcaaacattcaagaaaacacacagactccaactgtacaagaggagagtgaagaggaagaggtcgatgaaacaggtgtagaagttaaggacattgaattggtcatgtcacaagcaaatgtgtcgagagcaaaggcagtccgagccctgaagaacaacagtaatgatattgtaaatgcgattatggaattaacaatgtaaccatatggaagcaactttttttggtgtctcaaaggagtaactgcagcttggtttgaaatttgtactgtttctatcataaataaagttatggcttcttgttggatgaattca

SEQ ID NO: 70 - DNA, 7608 bp, Homo sapiens
gaagcaactacggagccgcagcccagggagcaagtctccgcaaacttgctccgcattcacggcaggacttcccagccgctgtggatgttcaggaaaaccgagtctgttctgttagcgtggcctttgaatgcttcaaaaataaacagaggataaccaaccgcgggaggaaatttttagctggagagagttgtagttcctgtgtctgtctccaggactgtgatatgtgttgactgaagagctaactacaagttcatcgtgaagaataaatgagataagctacctcaagtgcctgtaccaaaatagactcacaatacattgaccctggaaacagacgggggattcttataagtcacaaaagaaaataaataacttcatccatggagggaaagagacagcttgagaaaagggactttggaaaaaggctgtctctagacagcagtcttgtggaatacatggactccaataaatacattgagcatctgctgactcagcttgaggagcaacacaggagtctctggagggagaagttggcagtggcccgactacagcgagaagttgcccaaagaacaagtgagggggccatgcatgagaagctgatacatgaactggaagaggagagacacttacgtcttcaaagcgagaagcggttgcaggaggtgaccctagagtctgaacgcaacagaattcagatgcgtagcttgcagcagcagttctccaggatggaagaaacagtacgaaatctattgcagagtcaaggatctccagagcagaaaaaagaagaaactgttaatataatggtctatcaggaaaagctgtcagaggaagagagaaaacataaggaagctttggaagatcttcacatggtggttgatgaggattcgaggagtgaaagcagcagtacagatgagggaaaagaaaagaccaaattgctattagagagattgaaagctctagaggcagagaattcagcgttggctttggagaatgaaaatcaaagggaacaatatgagcgatgtcttgatgaggtagccaaccaagttgttcaagctctgcttactcaaaaggatctaagagaggaatgtgtgaagttgaaaacaagagtgtttgatttggaacagcagaatcgaacactaagcatcctattccaacagcgagtcagacccacttctgatctgctcctccagaaacttcactcacgtctcttggatctttcatctggagatttgctttcagaggtggaaagaaaccgaagtctgacacagtcacgaactgatgctgaggtgcacgaacaccaactaaatacaaaatcggccttgaaatgccctggcttgggggctgtcatccctggtcatctctgtcctcgaaacagctacagtagcagcagtgaactgtctctttcaagcacctgcagcgagtactccagtggctcctcctacacgtggcacgatgggaagaacctcaggaaaaggcaatcatcacaaaactgggataaaaggctaagtattgattcttcgctcccaagtggctttgctagtcctacaaatgaactacctccaactcgtatcaaggaaagccacattttggaagggctaagaaagctacagaagcgaaaagtgttacttgaacccccatcagtgataaccaaatggggttataaagattgcatgaactcgaatgaaggaatatattctcctggaattaaaagtagcagcctcaaggagtatcccccctgcaaaacagctgacctggggagcccctgcaaggaaccccacaagacatttgtttatgatctagattcccacgttgatgcggacgatgacccttccaccttagcattgctccaagcagttccaaaccagagctgcaggccacatggcagtaaattaacccacagtgtttccgacagtctgtttggctgggagacaaacagaaaacactttctggaaggcacatcctcagtttatcccaaggaaaggcctgaaaagctgacaagttgcgccagcagctgtcccttagagatgaagctgtgcccaagtgtgcagacgcctcaggtacagagggagaggggcccacagggccaaggccatggccgcatggctctcaacctccagctttcagacactgatgacaatgaaacgtttgatgagctgcacatagagagcagtgatgagaaaagtccttcagacgtgtcattggctgccgacaccgataagtccgtggagaacctggatgtccttgtggggtttggaaaatctctatgtgggtctcctgaagaggaggaaaaacaagtgcccatcccttcagagactaggccaaagacttttagtttcattaagcagcaaagagttgtaaaaaggacttcttcagaagaatgtgtgactgtgatatttgatgcggaagacggtgagcccattgaattcagctctcaccagactggggttgtcactgttaccagaaatgagatttccatcaattcaactcctgctggacccaaggcagaacatactgagcttttacctcagggaattgcttgtttacagccaagagctgctgcaagagactatactttctttaaaaggtctgaagaggacactgagaaaaacattccaaaagataatgtagataatgttcccagggtgtccactgaatctttcagctccaggacagtgacacaaaatcctcagcagcaaaagctggtcaaaccaacacacaatatatcatgccagagtaattccaggtcttcggcacccatgggcatctatcaaaagcaaaatctgacaaaaatacctcccaggggcaagtcttcacctcagaaatcaaaactaatggagcccgaagccaccacactactcccttcatctggcctggtgactcttgaaaaatcaccagccttagctcctgggaaactctcacgattcatgaagactgagagctcagggcccctctttgaattacgatcagatccacacattccaaaacattccgcccaacttccgcacagctccaggatgcccagcaggagggactgggtccagtgccccaagagtcagactccagggtcacggtcaaggcctgccattgagtctagtgacagtggagagccccccacgagggatgaacactgtggctctgggccggaggcaggggtgaaatccccttcccctccgccccctccaggcaggtccgtctccctgctggccaggcccagctatgactattcaccagcaccttcatccaccaagtccgaaaccagggtccccagtgaaacagcaaggaccccattcaaatccccgctgctgaaaggaatttctgctccagttatttcttctaatccggccacgacagaagtgcagaggaagaaaccttctgtggccttcaaaaagcctatcttcactcaccctatgccctccccagaagcagtcattcaaacccgatgccctgctcatgccccctccagctccttcaccgtaatggctctggggcctccaaaggtctctccgaagagaggtgtccccaaaacctctcctcgccaaacacttgggaccccacaaagggacataggattacagactcccaggatctctccttcaacccatgagccactggaaatgacgtcctccaaaagtgtatctccagggagaaaaggacaattgaatgatagcgcctccacaccccccaagccttccttcttaggggtaaatgagtcaccatcatctcaggtcagcagttcctcatcatcctcatcacccgccaaaagccataacagccctcatggttgtcaaagtgctcatgagaaaggactgaaaactcgccttccagtgggactcaaagtgctcatgaagtctccccagctgctcaggaaaagttccaccgtgccagggaaacatgaaaaagacagtttaaatgaagcctccaaaagttccgtggctgtgaacaagtctaagccagaggactccaagaatccagcaagcatggagatcacagcgggtgaaagaaatgtgaccctaccggattcacaagcacagggcagtttagctgatgggcttcccctggaaacagcactacaagagccattggaaagtagcatccctgggagtgatggaagggatggggtagataatagatccatgagaagatccctttcctccagcaaaccacacctaaaaccagctctgggtatgaatggcgccaaagcccgcagccacagcttcagtacacactcaggagacaagccttctacgccccccatcgaagggtcaggcaaagtccgcactcagatcattaccaataccgccgagagaggcaattctcttacccggcagaactcttccacggaaagctctcccaacaaggccccttctgctcccatgttggagagtctccccagtgttgggaggccctcggggcacccctcctccgggaagggctccctggggagctcaggcagcttcagcagtcagcatgggagcccaagtaagttgcctttgaggatccctccaaagtctgagggactcctcatcccacctggaaaggaagaccagcaggccttcacccagggagagtgccccagtgccaatgtggctgtacttggggaaccaggcagtgaccgccgcagttgcccacccaccccaacagactgccctgaagccctgcagagcccagggaggactcagcatccaagcacttttgaaacaagcagtacatccaagctagaaacttctggaaggcatccagatgcctctgcaaccgcgactgatgctgtgagttcagaagcccccctctcacccacaatcgaagaaaaggtcatgttgtgcattcaggaaaatgtggaaaagggccaagtgcaaacaaagcccacctctgtggaagcaaagcagaagcctgggccttcttttgccagctggtttggttttcggaagagtagacttccagctctgagtagcaggaaaatggacatctccaaaaccaaagtagaaaagaaagatgcaaaagtcttggggtttggaaacagacaactaaaatcagaaagaaaaaaagagaaaaagaagcctgaactacagtgtgagacagaaaatgagcttatcaaggacaccaagtcagcagataatccagatggcggtttacaaagcaaaaataatcggagaacaccacaagacatttacaaccaactgaagattgaaccaaggaatagacacagccctgttgcatgttcaacgaaagacaccttcatgacggaactcttgaacagagttgataagaaagcagctccacagacagaaagtggatcaagtaatgcttcctgcaggaatgtgttaaagggcagttctcagggctcctgtctcatcggcagctctatcagtactcaaggaaaccacaagaaaaacatgaaaatcaaagccgatatggaagtaccaaaagactccctggtaaaagaggcaaatgaaaacttgcaagaggatgaagacgatgcagttgcagattctgtatttcagagccacatcatagaatccaactgccagatgagaacattggacagtgggatcggaacctttccactcccagactcgggaaatcgctcgacaggacgctacctatgccagccagactccccagaggacgctgagcctctcctgcctctccagtcagccctttctgcagtttcttccatgagagcccaaacccttgaacgtgaagtgccttcctccacagacggccagcgccctgcagatagcgccattgttcattccacatccgaccccatcatgaccgccagagggatgaggcctcttcagagccgcctccccaaaccagcttcctcaggaaaagtcagttcccaaaagcagaatgaagcagagccaaggcctcagacatgctcatcattcggatatgctgaagacccaatggcaagccagccgcttccagactgggggagtgaagttgctgccaccgggacccaggacaaggcacccagaatgtgtacgtactctgccagcggtggcagtaatagtgacagtgacctggactatggagataatggttttggagctggaaggggacagttagtgaaagcactgaagagcgctgccccagaaattgagacaacttgaagaaacaaaagacgatcccgagaatagattatcgaaaatttccctagagtcattcaataaatttaacagcaatactgtgattttattagaaaaagagaagaactctctgaacaaggttgaaggacagaaggaagaaaaagaaaaaaatgaagagacatctttgagtagttcagataggcctggggtagacaacttggaatctttgagtgattctttatatgatagcttctcttcctgtgccagtcaaggttcaaatgatgtataaaggacatctcttcccttagtgagctgggactggagcgcttaagaaatgatgggtggggggtggggggtgcaccgcttgatagagataacaataaactattgcagtaccagagccttccttgtcaaattcacagcaggcaacccaccagagcttatttctctgacagggcaataaagatagactccatttattgtgtttcaagaggattaagcgtaaacacatctatgatacagaatccttaattttgcactttttttgaatatttgtacagaagttgtaaattttttggaagagaaattatatttgtagcaaaaaaagacagcaataaatggaatcagtgccatgctcttgaaataatgtactaagtcttagaagttgatgataatatatattttttaaaatcccaactgaagtttttgtgaagttcgttgtcctggtcctcaaattgtttgtgggtacactctgtaaacctacaacagggcctgccaaaaaatcggagggttcctcctcatctccatctcacaaatctcaatttgatggaaatgttcattttagtgtaatttcagattcgttgccagagattcaggtgatagtaataagtgtcattctgcttctgctgaaaaatgaaaagggtcctgaagtgtggacactgattgggagtgtgacattgtatcagaaatgaccgaattctattcccaataccagtttttccttccagacatttctttagattgtcttttacttagtgcttctctatgatcctgaatattatttgatttttatcttcttgctctttttattaaaatctgggcactctaaaaatgaaaacaaatttctatttgcaatgttcacttttaaaaataaaattaatggtgctacgaagaattctttttaatatccttttttttctacaaagactgtttatatgtaaggataaattctattttaaaggttatgtgtattttttctagatgtgaactatttataattacttatgtacaggagcttgtaaactaggcccaatagaaatatttttaggatctatatggctactttagcacataattgtttctttaaagagtattgtatgatcagtgttatttggttaatttgtgcaatttgttttattttatcttaaatgaaaattatgtaaaatgtccttgtctttcagactttaaaaaatctttttgtttcctttctgaataaaagttatatcacatttgcaccctctgaaaa

SEQ ID NO: 71 - DNA, 1275 bp, Homo sapiens
gtctccgcctgcaggtgcagacatctggaggagagagtcggagagcagaaaccacttggctcccagacaattcccctacaggctttgggcctggaattgaggagaaagtgagctaagttggggtggggtgagtccaaagaagcacgggctgggccaagctaagctgctctgggctgggctgatccctccccactcaggggcgggaccccaggaggagggagaggacagagccactgcagaggaccagactgggaaaacaacgatatggcaggagccagtcttggggcccgcttctaccggcagatcaaaagacatccggggatcatcccgatgatcggcttaatctgcctgggcatgggcagcgctgcgctttacttgctgcgactcgcccttcgcagccccgacgtctgctgggacagaaagaacaacccggagccctggaaccgcctgagccccaatgaccaatacaagttccttgcagtttccactgactataagaagctgaagaaggaccggccagacttctaagccaggctgggctgccagtgccatgcaagccacagccagccagcccatccacttcttccactcctccccgcaggccccaaggcatcactccggccaccctgtcccgctactgcttacacaggccgggttcccacgcagaggggaggctgctccacccctactctcctcccttgctcccagcagcggaagcgcctctgacccttggcttgagtcccacgtgggggaggaggaggcaggcagcaccagcaggggtccaccaagagcccagaccagcccctctgccctcctacccgggcctcgaagggtgtggcacaggctacgtgttgagcgtggcctacgtgagccaacaagaagcaggggcctctgagtgccaagcgacgtggcgggctccacgttagcccaggctctgagagccagcccaggggcggcgctgctcagcttgggctggtccagggcctgcccaggctggggcacctttgcctcctgaggcgcagcgcactcctcccctgcccaagcctactgcctcccgctgccgccagtaccccctccagccccacacctgggcctccccctgccactcccctcccttgctcccctctgtccccagggatcaaacagaagcagccgtgggcaaaatacaatttcatttaacaaattgaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 72 - DNA, 5610 bp, Homo sapiens
gttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccacatctcccctcaccctcaccctccctgcctggccctggaccccatcccaggacctccctatcagctgacttcttccagtgtcttgcaggcccctctgggctcctccctcccctggcttttcctaccactccccctctatcggcgtctatctgtaggtgccctgggatttataaaactgggttccgaatgctgaataagagacggtaagagccaaggcaaaggacagcactgttctctgcctgcctgataccctcaccacctgggaacatcccccagacaccctcttaactccgggacagagatggctggcggagcctggggccgcctggcctgttacttggagttcctgaagaaggaggagctgaaggagttccagcttctgctcgccaataaagcgcactccaggagctcttcgggtgagacacccgctcagccagagaagacgagtggcatggaggtggcctcgtacctggtggctcagtatggggagcagcgggcctgggacctagccctccatacctgggagcagatggggctgaggtcactgtgcgcccaagcccaggaaggggcaggccactctccctcattcccctacagcccaagtgaaccccacctggggtctcccagccaacccacctccaccgcagtgctaatgccctggatccatgaattgccggcggggtgcacccagggctcagagagaagggttttgagacagctgcctgacacatctggacgccgctggagagaaatctctgcctcactcctctaccaagctcttccaagctccccagaccatgagtctccaagccaggagtcacccaacgcccccacatccacagcagtgctggggagctggggatccccacctcagcccagcctagcacccagagagcaggaggctcctgggacccaatggcctctggatgaaacgtcaggaatttactacacagaaatcagagaaagagagagagagaaatcagagaaaggcaggcccccatgggcagcggtggtaggaacgcccccacaggcgcacaccagcctacagccccaccaccacccatgggagccttctgtgagagagagcctctgttccacatggccctggaaaaatgaggattttaaccaaaaattcacacagctgctacttctacaaagacctcaccccagaagccaagatcccctggtcaagagaagctggcctgattatgtggaggagaatcgaggacatttaattgagatcagagacttatttggcccaggcctggatacccaagaacctcgcatagtcatactgcagggggctgctggaattgggaagtcaacactggccaggcaggtgaaggaagcctgggggagaggccagctgtatggggaccgcttccagcatgtcttctacttcagctgcagagagctggcccagtccaaggtggtgagtctcgctgagctcatcggaaaagatgggacagccactccggctcccattagacagatcctgtctaggccagagcggctgctcttcatcctcgatggtgtagatgagccaggatgggtcttgcaggagccgagttctgagctctgtctgcactggagccagccacagccggcggatgcactgctgggcagtttgctggggaaaactatacttcccgaggcatccttcctgatcacggctcggaccacagctctgcagaacctcattccttctttggagcaggcacgttgggtagaggtcctggggttctctgagtccagcaggaaggaatatttctacagatatttcacagatgaaaggcaagcaattagagcctttaggttggtcaaatcaaacaaagagctctgggccctgtgtcttgtgccctgggtgtcctggctggcctgcacttgcctgatgcagcagatgaagcggaaggaaaaactcacactgacttccaagaccaccacaaccctctgtctacattaccttgcccaggctctccaagctcagccattgggaccccagctcagagacctctgctctctggctgctgagggcatctggcaaaaaaagacccttttcagtccagatgacctcaggaagcatgggttagatggggccatcatctccaccttcttgaagatgggtattcttcaagagcaccccatccctctgagctacagcttcattcacctctgtttccaagagttctttgcagcaatgtcctatgtcttggaggatgagaaggggagaggtaaacattctaattgcatcatagatttggaaaagacgctagaagcatatggaatacatggcctgtttggggcatcaaccacacgtttcctattgggcctgttaagtgatgagggggagagagagatggagaacatctttcactgccggctgtctcaggggaggaacctgatgcagtgggtcccgtccctgcagctgctgctgcagccacactctctggagtccctccactgcttgtacgagactcggaacaaaacgttcctgacacaagtgatggcccatttcgaagaaatgggcatgtgtgtagaaacagacatggagctcttagtgtgcactttctgcattaaattcagccgccacgtgaagaagcttcagctgattgagggcaggcagcacagatcaacatggagccccaccatggtagtcctgttcaggtgggtcccagtcacagatgcctattggcagattctcttctccgtcctcaaggtcaccagaaacctgaaggagctggacctaagtggaaactcgctgagccactctgcagtgaagagtctttgtaagaccctgagacgccctcgctgcctcctggagaccctgcggttggctggctgtggcctcacagctgaggactgcaaggaccttgcctttgggctgagagccaaccagaccctgaccgagctggacctgagcttcaatgtgctcacggatgctggagccaaacacctttgccagagactgagacagccgagctgcaagctacagcgactgcagctggtcagctgtggcctcacgtctgactgctgccaggacctggcctctgtgcttagtgccagccccagcctgaaggagctagacctgcagcagaacaacctggatgacgttggcgtgcgactgctctgtgaggggctcaggcatcctgcctgcaaactcatacgcctggggctggaccagacaactctgagtgatgagatgaggcaggaactgagggccctggagcaggagaaacctcagctgctcatcttcagcagacggaaaccaagtgtgatgacccctactgagggcctggatacgggagagatgagtaatagcacatcctcactcaagcggcagagactcggatcagagagggcggcttcccatgttgctcaggctaatctcaaactcctggacgtgagcaagatcttcccaattgctgagattgcagaggaaagctccccagaggtagtaccggtggaactcttgtgcgtgccttctcctgcctctcaaggggacctgcatacgaagcctttggggactgacgatgacttctggggccccacggggcctgtggctactgaggtagttgacaaagaaaagaacttgtaccgagttcacttccctgtagctggctcctaccgctggcccaacacgggtctctgctttgtgatgagagaagcggtgaccgttgagattgaattctgtgtgtgggaccagttcctgggtgagatcaacccacagcacagctggatggtggcagggcctctgctggacatcaaggctgagcctggagctgtggaagctgtgcacctccctcactttgtggctctccaagggggccatgtggacacatccctgttccaaatggcccactttaaagaggaggggatgctcctggagaagccagccagggtggagctgcatcacatagttctggaaaaccccagcttctcccccttgggagtcctcctgaaaatgatccataatgccctgcgcttcattcccgtcacctctgtggtgttgctttaccaccgcgtccatcctgaggaagtcaccttccacctctacctgatcccaagtgactgctccattcggaaggccatagatgatctagaaatgaaattccagtttgtgcgaatccacaagccacccccgctgaccccactttatatgggctgtcgttacactgtgtctgggtctggttcagggatgctggaaatactccccaaggaactggagctctgctatcgaagccctggagaagaccagctgttctcggagttctacgttggccacttgggatcagggatcaggctgcaagtgaaagacaagaaagatgagactctggtgtgggaggccttggtgaaaccaggagatctcatgcctgcaactactctgatccctccagcccgcatagccgtaccttcacctctggatgccccgcagttgctgcactttgtggaccagtatcgagagcagctgatagcccgagtgacatcggtggaggttgtcttggacaaactgcatggacaggtgctgagccaggagcagtacgagagggtgctggctgagaacacgaggcccagccagatgcggaagctgttcagcttgagccagtcctgggaccggaagtgcaaagatggactctaccaagccctgaaggagacccatcctcacctcattatggaactctgggagaagggcagcaaaaagggactcctgccactcagcagctgaagtatcaacaccagcccttgacccttgagtcctggctttggctgacccttctttgggtctcagtttctttctctgcaaacaagttgccatctggtttgccttccagcactaaagtaatggaactttgatgatgcctttgctgggcattatgtgtccatgccagggatgccacagggggccccagtccaggtggcctaacagcatctcagggaatgtccatctggagctggcaagacccctgcagacctcatagagcctcatctggtggccacagcagccaagcctagagccctccggatcccatccaggcgcaaagaggaataggagggacatggaaccatttgcctctggctgtgtcacagggtgagccccaaaattggggttcagcgtgggaggccacgtggattcttggctttgtacaggaagatctacaagagcaagccaacagagtaaagtggaaggaagtttattcagaaaataaaggagtatcacagctcttttagaatttgtctagcaggctttccagtttttaccagaaaacccctataaattaaaaattttttacttaaatttaagaattaaaaaaatacaaaaaagaaaaaatgaaaataaaggaataagaagttacctactcca

SEQ ID NO: 73 - DNA, 1956 bp, Homo sapiens
gtaagcaaggcttgaggcttgctctcgccttcgtcagcagccctcctcaatcttctccaaactcccgtccccaggccacacagattctcctcaagagagccctataaggacattggtaaaatgtcactgccttcaggacacactacgggtcacactgatcaagttgttcaaagaagagcaagatgttgggatatttaccaaaggagatttagcagtaggtctgaacctgtcaatcctggcatgcattcttcatcccatcagcagcaagatggagatgcagcaatgcatggtgcccacatggactctccagtaagatacactccctatactatttcaccctataatcggaaaggcagttttcgtaaacaagaccaaacccacgttaacatggagagagagcaaaaacctccagagagaagaatggaggggaacatgccggatgggaccttagggagctggttcaagatcacagttccctttggcataaaatacaatgagaagtggctgctgaatttgattcagaatgaatgcagtgtacccttcgtcccagttgagtttcactatgaaaacatgcatgccagcttctttgtggagaatgccagcatcgcctatgcactgaagaatgtcagtggcaagatttgggatgaggataatgaaaagatatcaatctttgtcaaccctgctggcataccccactttgtgcacagggagctgaagtcagaaaaggtggagcagataaagctggccatgaaccaacagtgtgatgtctcccaggaagctcttgatatccagagactcccattttacccagacatggtgaaccgtgatactaagatggcatcgaatcctagaaagtgcatggctgcctccctggacgtccatgaagagaacatacctacagtgatgtctgcaggggagatggacaagtggaaagggatagagccaggagagaagtgtgcggacagaagcccagtgtgcacgaccttctcggatacctccagcaacataaactccatcctggaattgttccccaaattattatgcctggatggccagcagtcacccagagcaactttatgtggtactgaagcccacaagaggttaccaacctgtaagggaagcttctttggatctgagatgttgaagaatctggtcctgcaattcctgcagcagtattacttgatctatgactctggagatcgacagggtctccttagtgcttaccacgatgaggcctgcttctccctgagcattcccttcaatcctgaggactcagccccgagcagcttctgcaagttcttcaaggatagcaggaatataaaaattctcaaggacccctaccttcggggggagctgctgaagcacacaaaacttgatattgtggactccctcagtgcgttgcctaaaactcagcatgacctcagctccttcctggtggacatgtggtaccagacggaatggatgctctgcttttctgtcaacggggtgttcaaggaagtggaaggacagtctcagggttctgttctcgccttcacccggaccttcattgctacccctggcagcagttccagtctgtgcatcgtgaatgacaagctctttgtgcgggataccagccaccaagggacccagagtgccttgttcaccctagtgcccacagccttctccagctccgtgcctgccttctcccaggagcagcagaaaatgctgccttcgtaacaaccagtgtgactacgtcagagctcctcatgttcttgcatggcccaagatgtatttccctgtgactgaaccaggagatctggctggggctaagaagccgaagcccaactcacagggctgactctcatccttccaaaggggccagttgttctgtgcacttgtccacccctgttacccccaggatctctgttccttttcacaataaagtatggtgtcttgttatgtcaaatccctgcaaaa

SEQ ID NO: 74 - DNA, 2204 bp, Homo sapiens
agttcctgttttggcctccgctgtcccgctccggctcctggggctccccgcagacgctgcttttcttgctccactgggggtgcctcttcctgggcgcccgccgcctgcatcctgctcgtcctgtctgggaatggggccgcccccgggcttgggccggcccggctggggcccccgaggcgcttccgccccgtagtgaccgcctggtgccgccccccccccaggatgaagggcggcgagggggacgcgggcgagcaggccccgctgaaccctgagggcgagagccctgcaggctcggccacgtaccgggagttcgtgcaccgcggctacctggacctcatgggggccagtcagcactcgctgcgggcgctcagctggcgccgcctctacctcagccgggccaagctcaaagcttccagccgcacgtctgccttgctctcgggcttcgccatggtggccatggtggaggtgcagctggagagtgaccacgagtacccaccaggcctgctggtggccttcagtgcctgcaccaccgtgctggtggctgtgcacctctttgcactcatggtctccacgtgtctgctgccccacattgaagctgtgagcaacatccacaacctcaactctgtccaccagtcgccacaccagagactgcaccgctacgtggagctggcctggggcttctccactgccctgggcacctttctcttccttgctgaagttgtcctggttggttgggtcaagtttgtgcccattggggctcccttggacacaccgacccccatggtgcccacatcccgggtgcccgggactctggcaccagtggctacctcccttagtccagcttccaatctcccacggtcctctgcgtctgcagcaccgtcccaagctgagccagcctgcccaccccggcaagcctgtggtggtggtggggcccatgggccaggctggcaagcagccatggcctccacagccatcatggtacccgtggggctcgtgtttgtggcctttgccctgcatttctaccgctccttggtggcacacaagacagaccgctacaagcaggaactagaggaactgaatcgcctgcagggggagctgcaggctgtgtgagactggtgttagccaccgctcactgcaagcactgcctccctccggggtctgtaagaggccgcaggggcctacagacctcatccccccatcccctggctggagccacttccagtggccactctcaggcagagttcagattcctgcccgcagggtcctctgggctgggccttggggcagctcccacattcccagggattttccccatcagtctgtcccttgggttttgcaagctactctgcacctgggctggcctcagttgaaggatcatgcagtagatagaggggaggcagggagagcttgtgggaccttcagtgctgactttagccaccatttccattcctatacaggatgtgaaggtcagaaggcagccaattgttggtttaatttttttttttttttgagacagtctgtttcccaggctggagtgtagtgatacagtcacagctcactgtagcctcgaccttccaggctcaaaagatgctcccaccacagcctcccaggtagtgagtagctggtactacaggtgtgtgctgccacacccgactaatttttttgtagagacggggtttcgctgttcccaggctggtctcaaactcctgggctcaagtgaacctcccgcctcggcctcccaaagtgctgggattcctttctttatttctgtagaatctattttatggttggcattttgggggaagatttcgatgggttccacattcttgctttagttgttgtagagggatttgggtgtttctacccaaggcattggtctagcttttcctacaatgaacctatctttggaggttcaagctccccaccttcccccactgtggtgacctgtggccacttgcagaagggatggtgcctgacccactgccctagccccacgctatgcaccaaacttgttctccccgtcctggtccagggctggggtctttagagactgacagcctctgccccaggcctgagtccttagcaagggttgggtaaggaggttttaagggagaaggtccagtccttagcccttgaaatacaaagctcttctgacactgaatttggatgcaccttgttttatataataaatcgtgtttcacaga

SEQ ID NO: 75 - DNA, 4758 bp, Homo sapiens
agagactgaacagccggcgagcaaatcaacggcatccagaaagccatgtcggactcggcgcccagcgcccaagcgctaacccgctgaaagtttctcagcgaaatctcagggacgatctggaccccgctgagaggaactgcttttgagtgagatggtcccagaggcctggaggagcggactggtaagcaccgggagggtagtgggagttttgcttctgcttggtgccttgaacaaggcttccacggtcattcactatgagatcccggaggaaagagagaagggtttcgctgtgggcaacgtggtcgcgaaccttggtttggatctcggtagcctctcagcccgcaggttccgggtggtgtctggagctagccgaagattctttgaggtgaaccgggagaccggagagatgtttgtgaacgaccgtctggatcgagaggagctgtgtgggacactgccctcttgcactgtaactctggagttggtagtggagaacccgctggagctgttcagcgtggaagtggtgatccaggacatcaacgacaacaatcctgctttccctacccaggaaatgaaattggagattagcgaggccgtggctccggggacgcgctttccgctcgagagcgcgcacgatcccgatgtgggaagcaactctttacaaacctatgagctgagccgaaatgaatactttgcgcttcgcgtgcagacgcgggaggacagcaccaagtacgcggagctggtgttggagcgcgccctggaccgagaacgggagcctagtctccagttagtgctgacggcgttggacggagggaccccagctctctccgccagcctgcctattcacatcaaggtgctggacgcgaatgacaatgcgcctgtcttcaaccagtccttgtaccgggcgcgcgtcctggaggatgcaccctccggcacgcgcgtggtacaagtccttgcaacggatctggatgaaggccccaacggtgaaattatttactccttcggcagccacaaccgcgccggcgtgcggcaactattcgccttagaccttgtaaccgggatgctgacaatcaagggtcggctggacttcgaggacaccaaactccatgagatttacatccaggccaaagacaagggcgccaatcccgaaggagcacattgcaaagtgttggtggaggttgtggatgtgaatgacaacgccccggagatcacagtcacctccgtgtacagcccagtacccgaggatgcccctctggggactgtcatcgctttgctcagtgtgactgacctggatgctggcgagaacgggctggtgacctgcgaagttccaccgggtctccctttcagccttacttcttccctcaagaattacttcactttgaaaaccagtgcagacctggatcgggagactgtgccagaatacaacctcagcatcaccgcccgagacgccggaaccccttccctctcagcccttacaatagtgcgtgttcaagtgtccgacatcaatgacaaccctccacaatcttctcaatcttcctacgacgtttacattgaagaaaacaacctccccggggctccaatactaaacctaagtgtctgggaccccgacgccccgcagaatgctcggctttctttctttctcttggagcaaggagctgaaaccgggctagtgggtcgctatttcacaataaatcgtgacaatggcatagtgtcatccttagtgcccctagactatgaggatcggcgggaatttgaattaacagctcatatcagcgatgggggcaccccggtcctagccaccaacatcagcgtgaacatatttgtcactgatcgcaatgacaatgccccccaggtcctatatcctcggccaggtgggagctcggtggagatgctgcctcgaggtacctcagctggccacctagtgtcacgggtggtaggctgggacgcggatgcagggcacaatgcctggctctcctacagtctcttgggatcccctaaccagagcctttttgccatagggctgcacactggtcaaatcagtactgcccgtccagtccaagacacagattcacccaggcagactctcacggtcttgatcaaagacaatggggagccttcgctctccaccactgctaccctcactgtgtcagtaaccgaggactctcctgaagcccgagccgagttcccctctggctctgccccccgggagcagaaaaaaaatctcaccttttatctacttctttctctaatcctggtttctgtggggtttgtggtcacagtgttcggagtaatcatattcaaagtttacaagtggaagcagtctagagacctataccgagccccggtgagctcactgtaccgaacaccagggccctccttgcacgcggacgccgtgcggggaggcctgatgtcgccgcacctttaccatcaggtgtatctcaccacggactcccgccgcagcgacccgctgctgaagaaacctggtgcagccagtccactggccagccgccagaacacgctgcggagctgtgatccggtgttctataggcaggtgttgggtgcagagagcgcccctcccggacagcaagccccgcccaacacggactggcgtttctctcaggcccagagacccggcaccagcggctcccaaaatggcgatgacaccggcacctggcccaacaaccagtttgacacagagatgctgcaagccatgatcttggcgtccgccagtgaagctgctgatgggagctccaccctgggagggggtgccggcaccatgggattgagcgcccgctacggaccccagttcaccctgcagcacgtgcccgactaccgccagaatgtctacatcccaggcagcaatgccacactgaccaacgcagctggcaagcgggatggcaaggccccagcaggtggcaatggcaacaagaagaagtcgggcaagaaggagaagaagtaacatggaggccaggccaagagccacagggcggcctctccccaaccagcccagcttctccttacctgcacccaggcctcagagtttcagggctaacccccagaatactggtaggggccaaggccatgctccccttgggaaacagaaacaagtgcccagtcagcacctaccccttcccccccagggggttgaatatgcaaaagcagttccgctgggaacccccatccaatcaactgctgtacccatgggggtagtggggttactgtagacaccaagaaccatttgccacaccccgtttagttacagctgaactcctccatcttccaaatcaatcaggcccatccatcccatgcctccctcctccccaccccactccaacagttcctctttcccgagtaaggtggttggggtgttgaagtaccaagtaacctacaagcctcctagttctgaaaagttggaagggcatcatgacctcttggcctctcctttgattctcaatcttcccccaaagcatggtttggtgccagccccttcacctccttccagagcccaagatcaatgctcaagttttggaggacatgatcaccatccccatggtactgatgcttgctggatttagggagggcattttgctaccaagcctcttcccaacgccctggggaccagtcttctgttttgtttttcattgtttgacgtttccactgcatgccttgacttcccccacctcctcctcaaacaagagactccactgcatgttccaagacagtatggggtggtaagataaggaagggaagtgtgtggatgtggatggtgggggcatggacaaagcttgacacatcaagttatcaaggccttggaggaggctctgtatgtcctcaggggactgacaacatcctccagattccagccataaaccaataactaggctggacccttcccactacataatagggctcagcccaggcagccagctttgggctgagctaacaggaccaatggattaaactggcatttcagtccaaggaagctcgaagcaggtttaggaccaggtccccttgagaggtcagaggggcctctgtgggtgctgggtactccagaggtgccactggtggaagggtcagcggagccccagcaggaagggtgggccagccaggccattcttagtccctgggttggggaggcagggagctagggcagggaccaaatgaacagaaagtctcagcccaggatggggcttcttcaacagggcccctgccctcctgaagcctcagtccttcaccttgccaggtgccgtttctcttccgtgaaggccactgcccaggtccccagtgcgccccctagtggccatagcctggttaaagttccccagtgcctccttgtgcatagaccttcttctcccacccccttctgcccctgggtccccggccatccagcggggctgccagagaaccccagacctgcccttacagtagtgtagcgccccctccctctttcggctggtgtagaatagccagtagtgtagtgcggtgtgcttttacgtgatggcgggtgggcagcgggcggcgggctccgcgcagccgtctgtccttgatctgcccgcggcggcccgtgttgtgttttgtgctgtgtccacgcgctaaggcgaccccctcccccgtactgacttctcctataagcgcttctcttcgcatagtcacgtagctcccaccccaccctcttcctgtgtctcacgcaagttttatactctaatatttatatggctttttttcttcgacaaaaaaataataaaacgtttcttctgaaaa

SEQ ID NO: 76 - DNA, 7311 bp, Homo sapiens
gcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcggttgcctcttggtgctgccttggccgtatttggcacccagaatgcttcattctgtgacggtctattaataaggttgccttgctagagtttggagcagggcctcagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagacttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactccctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatatcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgtggagaaatgtaaattgtaataatgtaaatgggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtgtgtgtgtatatatacacacacacacacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagtgtgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaattatagaatggcttta

SEQ ID NO: 77 - DNA, 6132 bp, Homo sapiens
cttcgctcgccgcctcgctcagagccggggccgggccagagcggcgccccgctgccctgtccccgcgtgcagaccccgggcccggccccggccccccgccaagccatgctgtgcggccgctggaggcgttgccgccgcccgcccgaggagcccccggtggccgcccaggtcgcagcccaagtcgcggcgccggtcgctctcccgtccccgccgactccctccgatggcggcaccaagaggcccgggctgcgggcgctgaagaagatgggcctgacggaggacgaggacgtgcgcgccatgctgcggggctcccggctccgcaagatccgctcgcgcacgtggcacaaggagcggctgtaccggctgcaggaggacggcctgagcgtgtggttccagcggcgcatcccgcgtgcgccatcgcagcacatcttcttcgtgcagcacatcgaggcggtccgcgagggccaccagtccgagggcctgcggcgcttcgggggtgccttcgcgccagcgcgctgcctcaccatcgccttcaagggccgccgcaagaacctggacctggcggcgcccacggctgaggaagcgcagcgctgggtgcgcggtctgaccaagctccgcgcgcgcctggacgccatgagccagcgcgagcggctagaccactggatccactcctatctgcaccgggctgactccaaccaggacagcaagatgagcttcaaggagatcaagagcctgctgagaatggtcaacgtggacatgaacgacatgtacgcctacctcctcttcaaggagtgtgaccactccaacaacgaccgtctagagggggctgagatcgaggagttcctgcggcggctgctgaagcggccggagctggaggagatcttccatcagtactcgggcgaggaccgcgtgctgagtgcccctgagctgctggagttcctggaggaccagggcgaggagggcgccacactggcccgcgcccagcagctcattcagacctatgagctcaacgagacagccaagcagcatgagctgatgacactggatggcttcatgatgtacctgttgtcgccggagggggctgccttggacaacacccacacgtgtgtgttccaggacatgaaccagccccttgcccactacttcatctcttcctcccacaacacctatctgactgactcccagatcggggggcccagcagcaccgaggcctatgttagggcctttgcccagggatgccgctgcgtggagctggactgctgggaggggccaggaggggagcccgtcatctatcatggccataccctcacctccaagattctcttccgggacgtggtccaagccgtgcgcgaccatgccttcacgctgtccccttaccctgtcatcctatccctggagaaccactgcgggctggagcagcaggctgccatggcccgccacctctgcaccatcctgggggacatgctggtgacacaggcgctggactccccaaatcccgaggagctgccatccccagagcagctgaagggccgggtcctggtgaagggaaagaagttgcccgctgctcggagcgaggatggccgggctctgtcggatcgggaggaggaggaggaggatgacgaggaggaagaagaggaggtggaggctgcagcgcagaggcggctggccaagcagatctccccggagctgtcggccctggctgtgtactgccacgccacccgcctgcggaccctgcaccctgcccccaacgccccacaaccctgccaggtcagctccctcagcgagcgcaaagccaagaaactcattcgggaggcagggaacagctttgtcaggcacaatgcccgccagctgacccgcgtgtacccgctggggctgcggatgaactcagccaactacagtccccaggagatgtggaactcgggctgtcagctggtggccttgaacttccagacgccaggctacgagatggacctcaatgccgggcgcttcctagtcaatgggcagtgtggctacgtcctaaaacctgcctgcctgcggcaacctgactcgacctttgaccccgagtacccaggacctcccagaaccactctcagcatccaggtgctgactgcacagcagctgcccaagctgaatgccgagaagccacactccattgtggaccccctggtgcgcattgagatccatggggtgcccgcagactgtgcccggcaggagactgactacgtgctcaacaatggcttcaacccccgctgggggcagaccctgcagttccagctgcgggctccggagctggcactggtccggtttgtggtggaagattatgacgccacctcccccaatgactttgtgggccagtttacactgcctcttagcagcctaaagcaagggtaccgccacatacacctgctttccaaggacggggcctcactgtcaccagccacgctcttcatccaaatccgcatccagcgctcctgagggcccacctcactcgccttggggttctgcgagtgccagtccacatcccctgcagagccctctcctcctctggagtcaggtggtgggagtaccagccccccagcccacccacttggcccactcagcccattcaccaggcgctggtctcacctgggtgctgagggctgcctgggcccctcctgaagaacagaaaggtgttcatgtgacttcagtgagctccaaccctggggccctgagatggccccagctcctcttgtcctcagcccacccctcattgtgacttatgaggagcaagcctgttgctgccaggagacttggggagcaggacacttgtgggccctcagttcccctctgtcctcccgtgggccatcccagcctccttcccccagaggagcgcagtcactccacttggccccgaccccgagcttagcccctaagccctcctttaccccaggccttcctggactcctccctccagctccggaacctgagctccccttcccttctcaaagcaagaagggagcgctgaggcatgaagccctggggaaactggcagtaggttttggtttttattttttgagacagggtctcgctccgtcgcccaggctggagtgcaatgttgcaatcatggctcactgcagctttgaactcccaggctcaagcgatcctcccatctcagcctcctgagtagctgggactacaggcacaggccaccaaacctggctaatgtttaaattttatgtagagatggcggggggggcgggggtctccctatgttgcccaggctggtctcgagctcctgacctcaagtgatcctcctgccccagcattccaaagtgctgggattacaggtgtgagccactgcctggcctggccgtaggtttgtaactgtttcatagaagagccctggagaagacagtagaatgagcctatctagtttaaaaaataaagaagcacgttgatttcaccaccgccactccctgagcacctctatgctgccacccccacaggcccatgaggagggacagggctggatgagtttcttgggcctctcccctcaacagggcatggacttggctaagacagccagggggtggcagcaggagatgccacagctctaaatagcccgatccctgctcctggcttaaagctgctgcgagtatcacaagactgtctgaggatgccaattcagcaggtcagcgcctccccacaacacacacacacacacacacacacacacactcacacatacacagaggggccttgaatgaggaggagacaggagtctgagggaccctcagactgccactctccaggcttggctgggctcaaggcccctgtctgctcagtagggcaaatcccaaggacacgggcttcccttcctccagccagccagccttttacacaaaggctggaaacgctgcttgggccgcctctatagaaatgccaggagagcgcactggacactaggcgacagaatctggagaaaatcctgcacccgcccctgccagcagggtgaaatgtggaggcctggtgttttaggttctgccagccaacagtgccggcactggacaagggcagaacttgacattagtccccagagggtggcctggaactgggctgggataggccttgaactggccccaagccccacagaaaccaaaacacagggctggggcagactccaccttctagcaactccaagaactaatgcagaaagtggcagtgtcccccgctccttcatgctgggagtggcgtttggctctggttaatttgtgtgtctgaaagaggataatcagaatcaaaagggcccagaaggaatgggccgagccaggcgggccgggccaggcagcccgggcatctggcactcagggctgtcagagggtcaggctgccaaactgcagcctcaggatgggaggcacagtgaggctaagtccagttttagcaaatgaagagccattagcattgcccagcccctgcagagccaggtctggccaggggctggctggggggtctgggtcaggtgagcaccagacccagggctgagtgcccatcctgcttggcttctctggtttcgtatctggtaccaagaggaaggggtgaaggctaggatgagggcccaatactgagaaggctgccttgaaagggcaagagtcttttttttttttcttttgagacaaagtcttgctcgtcccccaggatggagtgcgatggcgtgatctcggctcactgcaacctctgcctcccgggttcaagcgattctcttgcctcagcctccggagtagctgggattacaggcgcccgccaccatacccagctaatttttgtatttttagtagagacggggtttcaccatgttggccaggctggtctcgaactcctgacctcaggtgatccacccgccttgacctcccaaagtgctgggattacaggcgtgagccactgcacccagccaaaagggcaagagtctttaaggaagtgaactgggaagcagaagcaagggagaaatcacagggttttttttttgtttgtttttttgagatggagtctcgctctgtcgcctaggctagagtgcagtggcacgaccttggctcactgcaagctccgcctcccgggttcacaccattctcctgcctcagcttcccaagtagctgggactacaggcgcccaccaccatgcccggctaatttttttgtgtttttagtagagacagggtttcatagtgttagccaggatggtctcgatctcctgacctcgtgatccacccgcctcgccctcccaaagtgctgggattacaggcgtgagccaccatgcccagcctgaaatcacagctttttatcccagaggcccatgggtagaaacaacacatagggctatgttctctcagcccaaagctaagggcaggaaaaaaggcatgggccataggagcctgagtgacttggtttgggacaggagggttggggggctttagaggggtcaggcaggtcctgtgtcctctcagtttccctggaaaggggcttggaggcaccagtcatggacctgaaaggatcagggggtcagggaatgggtaagttccagaggatgagaagagggggaatgggaagtcttaaacacagctactggggcccagcaacttgccatgttaaaatgcacccctagtgactcaaagaaccacccggccagtggtgcaggaggagagatgtggcacctgggcacagtgggaaggcacggggcctgcacctccaccagaggagccactgctgacctggaccaagggggctgctctgtgcccagctagggaagcctgggccggctcctgtgctgaggtgctcaggtgctggctgagagcccagttgctgctctaacttggagtgaacctgggtcaatagcagctcgtctctggcgggtgggaagggtctgacaacaccaagtttgccctggaagaagggcagccttaaaggaaggcctttggaagctggcctggtgctgtgggcttgagggactttgtgtccaagccctgtcgtcctggctccagcctaggctccagcactccatttcttccactgccacctgctgaccaggaataccaggacagaaggttttgttcagctgctttctttattagaaacaagtgagatgtattgagcagaacaacaa

SEQ ID NO: 78 - DNA, 4870 bp, Homo sapiens
gtcctttgctcccccagccttgggaggcggctgcgtcagggattccttggtggccctggagggtggataggctggcctgggggccatcaggacagcaggtgacggtcaggccaatgccagccgggcctgggcacagccctgtgggggcttcggagggccctgaggaggaggaggaagaggcagaggagagaaggccccacggaggtcctgtcgccagcgctgccactgcctgacctccgctgcccgaaggccggtgggcctctgtggcctccgtgaagcaggcccggctgtcgtcaggccatgtctggtccatggccctcccccgacagccggaccaagggaacggtggcctggctggcggaggtactcctctgggttggagggagtgtggtgctgtcttcagagtggcagctcggccccctggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccagtggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctttcca

SEQ ID NO: 79 - DNA, 3580 bp, Homo sapiens
gaggcccccatggagaagggacgggcaggatgtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 80 - DNA, 3026 bp, Homo sapiens
agtcccggggctgcagggagcgcagcgcgcgcggcccgggccccggccaccggacgccctaccggacacgaccctccctggagcttggacaactgcccacctcggacgctgcaccggacactgccccccacagggctggacactccaacggacactacttcccagctccggacattgctccctcctctcccggggccctggacgcttttccccctcccccctccgggggcccagacactgagcccccctcagcgtctggctagcgtccccttgcaccccagcccaggacactgcctcctccctgtcctcttctcccttctgctcctcccacctcatctttcccctgctcgggtcggagccccgccagttcctccgaccccctactgctcggccgcggctgcccgcgcccccatccgcagctcctcgcccggatgcctctccccgggggactatggtggcttctctgctgccgtcgaggcttcactcttctgcaccgggactacggggacggcgagcttagcggggacggggacgaggacgaggacgaggaaacctttgagctgcggaccccgagtccagcgggcggcgggaggggtcccctggaagtgacgctgactcagccagtgaggagcgggcctgtctccaacaggctgcagagctgggaggagacttggagcctcatcccggagaaagggctgccggaggacgacccggacatcgttgtgaaaggttggctgtaccgggagccccgcggaggaggggcgcggccctggctgcccccgcgccgagcctggtttgtgctcacgcgggactccctggatcagttcagcagcagcgggaaaggggcgcggcgtctcgggagcctcgtgctcaccagcctgtgctcggtgaccggcccagagcgcaggcgtaaggagacaggtctgtggtcagtgactgtgtctggtcggaaacacagtgtccgcctctgctccccacgccaggcagaggctgagcgctggggggtggcattgcgggaagtgatcgcctccaaggcacccctggagacccccacccagctactgctcagggacatacaggaaagttgcggggacccagaggccgttgccctcatttacctgaggaacccgattctgagacacactagtggagccttgtatgccccactcctgcccctgccctatggagtcagcgccccaggtccgggctatgcacccctgcgcgaggaggcggtgcggctgttcttggcgctgcaggcgctggagggggcgcggcgccccgggcccttgatgcagggtgtgctccaaacctgccgggacttgcccgcgctccgggatgaactcttcctgcagctggctaagcagacctcgggccctgcaggtccccccgggctcccggctacccaagaccctgcggccctgcggtactggcaactcctcacctgcatgagctgcaccttccgacctgggggagctgtgcgggggcacctcctggggcacttggagaggaccgagcaggcactcccggactcggaactggcggaatatgcgcgcttcatccggaaagcgctgggccggacgcgcggcagagagctggtgccctcgctggcggagatttccgcgttgagccaacggcaggagctgctgtgtaccgtgcactgtccgggggctggtgcctgtgctgtggccatcgactcccacaccacggcgggggaggtggctcgagagctggtggggcggctgggcttggcccggagccgcaacgcattcgcgctgtacgagcagcgaggggcccaggagcgagccctggctggggggaccctcgtggccgacgtgctcaccaggtttgagaacttggccgcggaggaagctgggttggaggactcgcccgactccgggtggagactatgtctgcgtcttcacggacctctgcaccctgaggggctgtccccagacggtcacgaactgcctttcctctttgagcaggctcacgctctgctgctgcggggccggccgcccccacccgacgacacgctgcgcgccctggcggcgctgcgcctgcagagcctgcagcgggacttctctccgcgggtgcccctgccccgcctggaccgcctgctcccgcccccggccccgccgcgcgaagacccgccccgcccgacccccaggccgcccccttccgctgccctgctggccggggcgctctggagcccgggcctggccaagaggcgggcggagcgggcccggcgcggcggggccggccgcactgcgggaagcattgcccgcgagggaggaggcggcgccggcacggcagctgccgtgctgggcggctggaagcggctacggggcatgggccgagctgaggccatggccgcctacctggccctggcggcgcagtgtccggggttcggcgctgctcggtatgacgttctggagctgagcacggagcctggtcggggtgctccacagaagctgtgcctgggcttgggagccaaggccatgtccctctcccggccaggggagacggagcccatccacagtgtcagctatggccatgtggccgcctgccagctaatgggcccccacaccctggccttgagggtgggagagagccagctcctcctgcagagcccccaggtggaagagatcatgcagctggtgaatgcctacttggccaacccctcccccgagaggccctgcagcagctcttctcctccatgccaagacctgccagacacctcccctcccagccagcgcccgggcctggacgagccccagggacagtctggctgcttggggcagctgcaggactgagcctgccaagaggtcacgacttccctcctgcctgcagcctgggccaggactgctctgagatttgagggaaacatggacccttttggccctgcagggacagggcacatcccacacccaagggctacaatgggtgtgggtaattttctagtttgtttcttaatttatttgtagaagagaagcaaaaaaaaaaaaaaagtttcttatttacacaaa

SEQ ID NO: 81 - DNA, 6153 bp, Homo sapiens
gagacgtgctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttatttta

SEQ ID NO: 82 - DNA, 11342 bp, Homo sapiens
acattcactgggcaagccgactgtgagccaggaagtgctcttggggagcccaggccaagccatccattcttgggtcctttggagggtagatatggattcccagtttctccagcggccagtgctccccctagtccacacagtgagaccgtgaaagcagatgctccggggcactcctgggcagcttttgctcagtggatgatgggtgactacagactccctgaccacccccagcccatggaaattctcaacctgtacttgggagacagcctggagccccacccaggagagtgcccaagggaaacgtgcagccatgaggatccaccggagcctttcgaggagcaaacctgggccactgaccctcctgaacctaccagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagtgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagatgagagggagggtggacacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccaaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaagagggaggtgtgtcagtgtgtgaggaagggaggtcaggcagctaggaccacctgcagtgtggcaggcttcatccctctttgctccaagtgtgtatgtgtgtctgtgcatgtgtgtagtgtctgtgtctgtgtgttcatgcatatgcaggagtcacacggtcataggccatcaaagctggaggagacctcagaatcattcattcacctacttgctcatttattcattcattcattttgcagataatatgggacgctttctatgtgccagtaccaggggattcacaaatgaattaaacatgtccctgactccatgagttgacaatcttgcccactggtttcctgctctcagtttacagaggcacttttatcttgctggggaagtgtgctgaaaagacacattcccagcccacacccagggatgctgattcagtcagcctgggtcagagggatagataaatatgtttaaagctccttgggtaattctgatgtgtaagtagcagttagctgcagtagagtccaattgcctcatttgattgaagtggaatcccagcatcaagtggacatgacttttggcccaagactgatgcttacaaactaagtggagtaggttatttgacctcactgaacatgcatccttttttttttttttttttttttttttttttggagacggagtttcgctcttgtaacccaggctggagtgcaatggtgtgatcttggctgactgcaacctccactgaatcaagcgattctcctgcctcagcctcccaagtagctaggattacaggcgtgtgccaccacgcccggctattttttgtatttttagtagagatggggtttcgtcatgttggctaggctggtctcgaactcctgacctcaggtagtctgcctgcctcggccccccaaagtgctgggattacaggcgtgaaccaccacacctggcctatgcatccttatttctaaaaccatgataaaaggtgaaagtctgaatgcatgtgtgtgtgacactttgatgctcctttgctcatgtagaaccggcacctctctttcacctgagcacgtggaatcttcagagccagatgatggtggctgcctggcctgccatagtcaatgctgcccaggcacctctgcctggagggtctgggttgtgggctgcagttatgacatgtgaccacttggaggcaggcttgcatctttctagcttctggctgctcaggtgtcctgctgtggagctgagctgtgctccctgaaaggcaggaagttattatgtgtgcccctgtgccatcaccgaaccaggaccttcaacttcgtaaaacccacagtggcctgggccaggactcccaccatctagggaagcctctcctagggaaaagactggggctctgacatcttcctgcagatggagagaaagaaagacatctcagaagtctatggggacagcctacagctccccacagggttgctccaggtaacgctggaaggtgaaagctgagcaggctccagtccccatcctaggtatggaacagatcaaaccaccacaggcctatgtctgaccttgttcccaccccatgctcctctcccacctgtgtccttctctttgcaggagaagggacagacagaggttctcagtgatgagctcaggctctggaagggcacttgaagtttggctttagttcttcctttcccatataggggagctcagcttccagggtcctgggcctgctgtgacccaggttgttactcctgatataactgcttcctgggctctcatgatctcagctgagcctggctttctgctgatgatatttgtttgttgcttgccaggcaccagggtagataaaaagatcaccaagacccgcacctttttccttaggagggtctgagtcttcaggagacggagacatatggaatgtgtcggggttggaaggagcaggactggagggtcggggtgaggggggcagagggaaacagggccgtcagggtggcctgaggccagatcatacagggtctccaatgcagccaaggagagtggctttttgtgaatgtgcagtgcaacttttttttttttttgagacagagtctcgctctgttgcccaggctggagtgcaatggtgcgatctcagctcactgcaacctccgcctcctgggttcaagagattctcctttcccagcctcccaagtagctgggattacaggcatgcaccaccatgcccagctaattttgtattttttagtagagacagggtttcaccatgttggtcaggctggtctcaaactcctgacctcaagtgatccagctgcctcggcctcccaaagcattgggatcacaggcgtgagccaacgtgcctggccagtgcagtgcaatttttaaagagaagagtgccaagctcagggcttggaggacagcctagggattttgttttaagaagatgagctgggcgcggtggctcatgcctgtaatcccagcactttgggaggctgaagcgggcgcatcacctgagatcaggagttcgagaccagcctggccaacgtggtgaaacccagtctttactaaaaatacaaaaaatagccgggcatggtggcacatgcctataatcccagctactcaggaggctgaagcaggagaatggcttgaacccaggaggcggaggttgcagtgagctgaggttgcgccattgcactccagcctgggtaacagagcgagactctgtcgaaaaagaaaaaaaagatgaaatgccttgaaaaagtaaggccaatgggtagggtcagaatatggcctgcaaatgcactgtactatttgtgtaacttatatgtaaatctgaaattatttcaaaataaatacaaaaagaaaaaaaggcaatatcccagaaccttgtgaaaacctggccgtagcaggtcctttttcctcctgctgagctgagcaggcatgctcacagatcctcaaggtttcttgaatggctactgtcctccccactggcccctctgccaacacctctgcccctcagcttttctgatgcccatgccccctcaccagctaactgtggcttgcacctttacctgttcccttcattttcccttctccagaggaagaggtgctctccacaagcctgtgaccaactgttcccctcagccggcacactggctcctcttctcctgcctgccacagacctctctccttcatgggcccactggggctctttgagcctattctctacccccttcattatcatgccttgcaaacaccatcatgagcaaaaatcaaagctggtgttagactctcttgctttccatagctgaccctggcttccctgctttctgtgatgaattcacggtatgtgtgggctttgccaactgttcccagcccttaccaggttcccattcatacctggctctaattcacaccttacaaatcggcgtccaccccacctttgcctgaaatggcacctcctagggcaattgatggctgcagtcatcaactctgatgccttctcagccttcttccgccatcacctctcagcgacctttggccttgatagctatgtgatcatctaccagaccctgcacccaggctcagcctgatcttgccccagtggccaggcccttgagtgggactgccgggaattgagtccagcttttctagccatctgaccgtggccagttagcctcttatgttctgtttgcttctctataaaatggggataataacactacttatgtcacaaggtcctcatgaagattaagtgaaattatgcacgtaaacatctcagaacaatgcctggcacagaagggacacctgtgaggttagctattaattcatagcctcaccagacttaccccacgtctgctcccctcctcctttgggctctggcttaggctctgccctcatgcatgccatcctgcttggatgctgggtagctttgcacttggctctgccttggcctgcaaataacaaatctgagctcaaatgagctttagcagaaaaggactttgattggctccaatagctgaataatctgtatccaggtcaggtgaggcttcatctcgggcttcactctgattcaaggccccttttctctcttgttcttttgggggctccatctcccaggcctatgagcaggaacaaccctcatgcttccaagatggccccaggaactctcaagatccattttcttggtgcaaatatagcagaaagtgactctctgcttcctggaagtttcaaactcaaatccaggaatagtctcctgtagcagcctgccttgggccgtgtgcccatatctgagccagtcactagagccaggggtttaaggagatcagagtccacttctggagaggatgagagtgaagtcagcaccaccaaaacatagggaccagctgtggagaaattgtgagtactggaaggacaggataggaggaatggatgatggggagaaaaccgactaatatgcagatgccctttcctccaagaggccttccctaagtcttcctccttcagtttctattacatgaaactctgtaactctcctctcctctctcctcttcttttttttttttttttttttgagatggagtcttgctcggtcgcccaggctggagtgcggtggcatgatctcggctcactgcaagctctgcctcccgagttcacgccattctcctgcctcagcctcccgagtagctgggactacaggcgcccgctaccatgcccggctaatttttttgtatttttagtagagacggggtttcaccgtgttagccaggatggtctcaatctcctgatcttgtgatccgcctgcctcagcctcccaaagtgctgggattacaggcgtaagccaccacgccccggccctcttcatttctttttgcctctctgcttccagagcaacataaactccctgtgggcaggaactgggattgttgatttccactgcttccccagggcctgatatctagagtcgaaagaatgcacatctcaaaactatgtcctggttctttttctactttcttgcatattctttttcaggcaggagtgcagtggcacgatctcaattcactgcaacctctgcctcccgggttcaagcaattctccttcctcagcctcctgagtagctgggattacaggcatgcaccaccacacccagctaatctttgtattttcagtagagatggggtttcaccatgttggtcaggctggtctcaaactcctgacctcgtgatccgccggcctctgcctcccaaagtactggtgcatattctttttctgtctttcctgctactccctcttgctcttcccacccctaaactatgtagcctcaaagatcttacctggctgactgctgggctttcaagatagtttctggaagaagtctctaaatctaagccttcaactctcatctctgttctgaatttcagacctggaattctaactgtccacaatacatggctcctcaatatatcttcctgaaattacaaatgaccatacggtacaggtgttactatattacctgtaagaccacactcggtgtcatctcctgcaaactagtcctctcctgactcctctgtttctgtgagtgattctgcgatggcttgaggtcatccgtttgctttgaaagatcacacaccaggatacatacagagatgtgacccggatggatggacctttgcctcacaatcagggtagaagcctctggttttcttatttctttgtcctcctctgtggtgtgacacaggttcaggaggaggtacccagacacagaagagatgctttccctgtgcaggcttgctgacagtcttgcccaccactcctggcctcctccctctacatgtccacattcgctgctctgaccctgagttggacccagctaggaattgtgacttcagttactagtatttcctctgagcctctagtcatggtcatgggctaatctgtatatgaaaacccacttgaaagaaatcccagtgctgaagaaagaattgaaacatacagatcgtttctttgctcaagggagtgtggatttcagtgctctcactgagcagaggctgagggtgaccaccttggatcttcctgcaggacacagcccagagaaactgagcctgaatttgctgccatgttttgaggacattatccacgctagtctctttcatctgggccgaggtgggtaattttccttagagtcaagtactagaaaaagttttgcttcttctaagagctggtacattgccctcttgtgaatgagagccatgtatgtgaccacaacaccctttcagttgaccactaagagactgaaggccaattccggatcaactttacagccgcctacggcctgctataccacccatggcatagtttctgtggtctgatgctttattttttattgcattttactaatttatggcatgcatatcatatgagcagtctcaaatcctccccagaacaaggtgaggaatatattaatatttaaaataaaataaacaaaatgtca

SEQ ID NO: 83 - DNA, 1631 bp, Homo sapiens
gtgcgcgggcgcgtcggccggcgagggagcagcaaacggccggcggcgggtgccgcgcggggggcgggcggcgcggagtaggtggcggcggccatggccgaggcgtcgccgcatcccggacggtacttctgccactgctgctccgtggagatcgtcccgcgcctgccggattatatctgtccaagatgcgagtctggttttatcgaggagcttccggaagagaccaggagcacagaaaatggttctgccccctccacagctcccacagaccagagccggccaccgttggagcacgtggaccagcacctgttcacgctgccgcagggctacggacagtttgctttcggcatcttcgatgacagcttcgagatccccacgttccctcctggggcgcaggctgacgacggcagggaccctgagagccggcgggagagagaccatccgtcccggcaccggtacggcgcccgacagccccgcgcccgcctcaccacgcggcgggccaccggccggcacgaaggcgtccccacgctggaagggatcatccagcagctcgtcaacggcatcatcacgcccgccaccatccccagcctgggcccctggggagtcctgcactcaaaccctatggactacgcctggggggccaacggcctggatgccatcatcacacagctcctcaatcagtttgaaaacacaggccccccaccggcagataaagagaaaatccaggccctccccaccgtccccgtcactgaggagcacgtaggctccgggctcgagtgccctgtgtgcaaggacgactacgcgctgggtgagcgtgtgcggcagctgccctgcaaccacctgttccacgacggctgcatcgtgccctggctggagcagcacgacagctgccccgtctgccgaaaaagcctcacgggacagaacacggccacgaacccccctggcctcactggggtgagcttctcctcctcgtcgtcatcgtcctcctccagctcgcccagcaacgagaacgccacaagcaactcgtgagcccacgtcggccgtcgggaaagcacggggcctttcccacccaccctcagccagcgccacacggcacccacagactgggtgccccggcggcgccacgcttggctggtcagcgctgcaggtcccgcctgttccagggcaggacccgggcccggcccaccggccccctggcttgggaaggcgtgggccacatggtcccctctggggcgtccccagcctccccgtcctctgtctaacctcaccctctaaacgttcagcggtggaaagatttttataattttaaattattactgctttgaaataaacggacgtttgagctcacgtggcggccatgcatggtttgtggcggaagacggggcccagcggctcccccagcgctgaagcacggggttcagcggctcccccagtgctgcaggtgccgccaggacgggccacgtgggcccccagcctccccctcggccgcctccacgacccggagtaggggggctcgggaccatgaggatgaccagcaaaattcaagaacaaaactgctccaacagacttttttaaaggaaaaaatatgtgtatcttgaaagctatttaaaatacactacttacaaagagaa

SEQ ID NO: 84 - DNA, 718 bp, Homo sapiens
agtctcttttccggttagcgcggcgtgagaagccatgagcagcaaagtctctcgcgacaccctgtacgaggcggtgcgggaagtcctgcacgggaaccagcgcaagcgccgcaagttcctggagacggtggagttgcagatcagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggccaagaagtatgatgcgtttttggcctcagagtctctgatcaagcagattccacgaatcctcggcccaggtttaaataaggcaggaaagttcccttccctgctcacacacaacgaaaacatggtggccaaagtggatgaggtgaagtccacaatcaagttccaaatgaagaaggtgttatgtctggctgtagctgttggtcacgtgaagatgacagacgatgagcttgtgtataacattcacctggctgtcaacttcttggtgtcattgctcaagaaaaactggcagaatgtccgggccttatatatcaagagcaccatgggcaagccccagcgcctatattaaggcacatttgaataaattctattaccagtt

SEQ ID NO: 85 - DNA, 2164 bp, Homo sapiens
ctctttcccttcggtgtgccactgaagatcctggtgtcgccatgggccgccgccccgcccgttgttaccggtattgtaagaacaagccgtacccaaagtctcgcttctgccgaggtgtccctgatgccaagattcgcatttttgacctggggcggaaaaaggcaaaagtggatgagtttccgctttgtggccacatggtgtcagatgaatatgagcagctgtcctctgaagccctggaggctgcccgaatttgtgccaataagtacatggtaaaaagttgtggcaaagatggcttccatatccgggtgcggctccaccccttccacgtcatccgcatcaacaagatgttgtcctgtgctggggctgacaggctccaaacaggcatgcgaggtgcctttggaaagccccagggcactgtggccagggttcacattggccaagttatcatgtccatccgcaccaagctgcagaacaaggagcatgtgattgaggccctgcgcagggccaagttcaagtttcctggccgccagaagatccacatctcaaagaagtggggcttcaccaagttcaatgctgatgaatttgaagacatggtggctgaaaagcggctcatcccagatggctgtggggtcaagtacatccccagtcgtggccctctggacaagtggcgggccctgcactcatgagggcttccaatgtgctgcccccctcttaatactcaccaataaattctacttcctgtccacctatgtctttgtatctacattcttgacggggaaggaacttcctctgggaacctttgggtcattgccctttcacttcagaaacaggttgacaactcagccctgctcatgaggcagcaaaccctgcaaagggctgggactggtggccttatgtcagttgtctactctggagcttgacttggacctccccaggtcctaggcagtaggttgaaaaacactgaagtgcttttcatgaagcacagctgcagcaaagccttgcaatcccaggctggggtcagcctacagttgtgttgcttattacaacacatgcggaccaagaggggcttgtgggctagaggctgaccagcagcgtttatttagcaagggtaggtgtgcatcacattgggcttgttctcacccatctggtttggccattcctccttggtgggaatcatccaggtactgctgaggtcacctgcgatttgccccatttcctatctctagcaacctcctgggccccatgcccccaccccttctagaacctgcattcccagggccttcaccacctgaccaaaggtctaggctaacctttggtcatttgtaacaagacctcggaacagacacgtgtgtggcatggtttggcctggggatcttagatgtctgacctgaactattgtagaacagcgctggcttttgggggagcagcaaaaatgagaggagtgctaggtgggtggcctgagcatctgtatccagggacaggactccaaaggcttttggtcccagagctggggtatgttggccccagcccccagcctgtggctcccaaaaggcctctggttttttgtaatctcagtttacagccatttcttaggtttttaattacctttattttattttgccaaacatacctgggaataccttttattttttttttaccttggggtgatggttccaaaccataaatgtgattatagttaacacatgacccttctagcgtcccagccagtgtttttcctgacctctcttctttggagaggaggatggaagggaggggtccggcatgctgctggcattttgctgtgtcctgcagcccctttccgggacacctgggttcacacagctttttagcttacataactggtgcagattttctgtgtggagatgttgccttgaccagccttggctggactttaccaggcatgcagaagcctgtaccaacacagactacagcacccaggaggtgcgagtgtggctgctcagcggttataacaggcctgactgcattgttcaccggattataatgagccaaaatgtttcccggtgtttgctggtttcagggaaggagtttgatatagcagattaaccaccctccttgtagctattggggcttaatggtttcctggtgattcttaccaatccacaataaacatggcccattggca

SEQ ID NO: 86 - DNA, 1127 bp, Homo sapiens
cttttccaagcggctgccgaagatggcggaggtgcaggtcctggtgcttgatggtcgaggccatctcctgggccgcctggcggccatcgtggctaaacaggtactgctgggccggaaggtggtggtcgtacgctgtgaaggcatcaacatttctggcaatttctacagaaacaagttgaagtacctggctttcctccgcaagcggatgaacaccaacccttcccgaggcccctaccacttccgggcccccagccgcatcttctggcggaccgtgcgaggtatgctgccccacaaaaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcatgcgttgcctgcccttcctccattgttgccctggaatgtacgggacccaggggcagcagcagtccaggtgccacaggcagccctgggacataggaagctgggagcaaggaaagggtcttagtcactgcctcccgaagttgcttgaaagcactcggagaattgtgcaggtgtcatttatctatgaccaataggaagagcaaccagttactatgagtgaaagggagccagaagactgattggagggccctatcttgtgagtggggcatctgttggactttccacctggtcatatactctgcagctgttagaatgtgcaagcacttggggacagcatgagcttgctgttgtacacagggtatttctagaagcagaaatagactgggaagatgcacaaccaaggggttacaggcatcgcccatgctcctcacctgtattttgtaatcagaaataaattgcttttaaagaaa

SEQ ID NO: 87 - DNA, 1296 bp, Homo sapiens
ctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgaca

SEQ ID NO: 88 - DNA, 2741 bp, Homo sapiens
aagcacttccttttcctgtggcagcagccgggctgagaggagcgtggctgtctcctctctccgccatggcgtgtgctcgcccactgatatcggtgtactccgaaaagggggagtcatctggcaaaaatgtcactttgcctgctgtattcaaggctcctattcgaccagatattgtgaactttgttcacaccaacttgcgcaaaaacaacagacagccctatgctgtcagtgaattagcaggtcatcagactagtgctgagtcttggggtactggcagagctgtggctcgaattcccagagttcgaggtggtgggactcaccgctctggccagggtgcttttggaaacatgtgtcgtggaggccgaatgtttgcaccaaccaaaacctggcgccgttggcatcgtagagtgaacacaacccaaaaacgatacgccatctgttctgccctggctgcctcagccctaccagcactggtcatgtctaaaggtcatcgtattgaggaagttcctgaacttcctttggtagttgaagataaagttgaaggctacaagaagaccaaggaagctgttttgctccttaagaaacttaaagcctggaatgatatcaaaaaggtctatgcctctcagcgaatgagagctggcaaaggcaaaatgagaaaccgtcgccgtatccagcgcaggggcccgtgcatcatctataatgaggataatggtatcatcaaggccttcagaaacatccctggaattactctgcttaatgtaagcaagctgaacattttgaagcttgctcctggtgggcatgtgggacgtttctgcatttggactgaaagtgctttccggaagttagatgaattgtacggcacttggcgtaaagccgcttccctcaagagtaactacaatcttcccatgcacaagatgattaatacagatcttagcagaatcttgaaaagcccagagatccaaagagcccttcgagcaccacgcaagaagatccatcgcagagtcctaaagaagaacccactgaaaaacttgagaatcatgttgaagctaaacccatatgcaaagaccatgcgccggaacaccattcttcgccaggccaggaatcacaagctccgggtggataaggcagctgctgcagcagcggcactacaagccaaatcagatgagaaggcggcggttgcaggcaagaagcctgtggtaggtaagaaaggaaagaaggctgctgttggtgttaagaagcagaagaagcctctggtgggaaaaaaggcagcagctaccaagaaaccagcccctgaaaagaagcctgcagagaagaaacctactacagaggagaagaagcctgctgcataaactcttaaatttgattattccataaaggtcaaatcattttggacagcttcttttgaataaagacctgattatacaggcagtgagaaacatgacttggtgtgctctgtaaagcttggttagaatttttttaaagtgacattttgttggccataatttagactgttacattttatatagtgtggtataaaatggggcatggatttatactaagtccatggagttcagtggaaggggaatgatttaaaaaaagttgtggttttctaaataatgtggcttgaaaaataggtgtaacaggacttggtcagaaacgcagaggctgttcaagtttagctccccaccagatggaaaataggttaaattctgtaaagatttaactttaaccacaagagggcacaactggagagcacaatttttttggtactgcagtaaaattgattacctcttgagaagtgttctttttaaccagctataacaatagagttgagtattttcacccatggtttgaaaaagtgccagaaggccacactggcccacatctgtaatcccaacactttgggaccctaaggtgggcagagcacttgagccaatgagttcaagaccagcctggtcaacatgatgaaatctcgtctctactgaaaatataaaaaatagccagtcatggtgcatgcctgtaaccccagctacttggaggctgaggcaagagaatcacttgaacctgggaggtggaggttgcaatgagccaagattgtaccattgccctccagcctgggcgtcagagcaagactctctgaaaagtaccagaagcatttttcaggactgcctgtgtgtcttggtgattatgttaaccaactgtgttcaaaagaagtacccatgaaatgcctccagatataagggtgtttttttttacccataaagctaaactgcaaatattaccctagaattaacctcttgtcctgtgtcaaaagtcttgttttgcatctggattgttaaactgtcagcttctctctgacagtctcgaactgtcaagacagtctcagttcacagccaaggtgatctgttaaccctccccatttccagggccaaatctcagttcttaagcacgtcgtttcttagcacggctttattttcatgctctttatttctctattttgtgcagccttacccctttaaagtccactgtgagtcctaccctgcagggcctcttaacacagtagagttcatgtgctactgatttggtgcctgccttcaaacacatgtgcaagttttgtggggttaaagatagccacttggtggcacaccacattggaagtgctgttcacccggtcatttgaaacggtgtttgaccacttggtgcgcaaatggcctatcggattaaaggatagccaaacccaa

SEQ ID NO: 89 - DNA, 945 bp, Homo sapiens
cttcttttccgacaaaacaccaaatggcggatgacgccggtgcagcgggggggcccgggggccctggtggccctgggatggggaaccgcggtggcttccgcggaggtttcggcagtggcatccggggccggggtcgcggccgtggacggggccggggccgaggccgcggagctcgcggaggcaaggccgaggataaggagtggatgcccgtcaccaagttgggccgcttggtcaaggacatgaagatcaagtccctggaggagatctatctcttctccctgcctattaaggaatcagagatcattgatttcttcctgggggcctctctcaaggatgaggttttgaagattatgccagtgcagaagcagacccgtgccggccagcgcaccaggttcaaggcatttgttgctatcggggactacaatggccacgtcggtctgggtgttaagtgctccaaggaggtggccaccgccatccgtggggccatcatcctggccaagctctccatcgtccccgtgcgcagaggctactgggggaacaagatcggcaagccccacactgtcccttgcaaggtgacaggccgctgcggctctgtgctggtacgcctcatccctgcacccaggggcactggcatcgtctccgcacctgtgcctaagaagctgctcatgatggctggtatcgatgactgctacacctcagcccggggctgcactgccaccctgggcaacttcgccaaggccacctttgatgccatttctaagacctacagctacctgacccccgacctctggaaggagactgtattcaccaagtctccctatcaggagttcactgaccacctcgtcaagacccacaccagagtctccgtgcagcggactcaggctccagctgtggctacaacatagggtttttatacaagaaaaataaagtgaattaagcgtgtta

SEQ ID NO: 90 - DNA, 7157 bp, Homo sapiens
gcagccgcattgcaagttttctgcgcggggaagatctgttgctggtgctggcgttcttaagcacggcgcccgaggccaccccaggcgggccgtgaggggagcaccagccgttggcagcggcagcaacaggaagccgcggggtctcctcccgcacctgggaagcaggcttctcgctgttacccggtggggaatagcccatctcccacatcggtggtgatcgccgctcgggaatgcgggcgtgaagggtccgagttgccgcccagcggggaggagaccccaggacgccggaaatcaccatcccaaagctgcaagaaggggggagaaagcattcttcattcagttgtgtgccttgtgggggatttttaaaaagtcgtttttttttttaaagaaacatttccgtgctactgtctgtcatcgtctctggggaaatcagccagaaccaccggaacgtaactgaaaccagacaagagaggcaggagcccaggcagtacctgcagcgtccgggcaccagagccaccttggaacaggaacgcgtctccggccgcggggctgcggctccgccaaactttggggcgggcggggcgggctggggcgcccagggggctctgtagaccgagggcggccccctaaccatgatgtttcgcgaccaggtcggggtgctggcgggctggtttaagggctggaacgagtgcgagcagactgttgcgctgctgtcgctgctcaagcgcgtgagccagacccaggcccgcttcctccagctctgcctggagcactcgctggccgactgcgccgagctgcacgtcctcgaacgcgaggccaacagccccggaatcattaaccaatggcaacaggaatccaaggataaagtgatttccctcctgttaactcatctgcctttgctgaagccaggaaacctcgacgcgaaagtagaatatatgaaactgctgcccaaaatcctggctcactctattgaacacaaccagcacattgaggagagcaggcagctgctgtcctatgctttgatacatccagccacttcgttagaagaccgtagtgctttagccatgtggctgaatcacttggaggaccgcacgtcgaccagctttggtggccagaaccgaggccgctcagactctgtggattatggacagacacactactatcaccaaagacagaactctgatgacaagctcaatgggtggcagaactctcgggattctgggatttgcatcaatgcctccaactggcaggacaaaagcatggggtgtgagaatggccatgtgcccctctactcctcctcatctgtccccaccacaatcaatacgattggaaccagcacaagtacaattctctcaggccaggcacaccacagccctttgaaacgatctgtgtcccttaccccacccatgaatgtgccaaaccagcctctaggacatggatggatgtctcatgaggacttacgagctagaggaccccagtgcctcccatccgatcatgcccccctgtctccacaaagcagtgtagcctcttcaggaagtggtgggagtgaacacttagaagatcagaccactgctcgtaacacattccaagaagaaggtagtgggatgaaagatgttccagcctggctgaaaagcctccgcctgcacaaatatgccgcgcttttctcccagatgacctatgaggagatgatggccctcaccgagtgccagctggaggcgcagaatgttaccaaaggtgcaagacacaaaattgtcatcagtattcagaagctcaaagaaagacaaaatctcctgaagtctttggaaagggacatcatcgaggggggcagcctgcgcatcccgctccaggaactgcaccagatgatcctgactccgatcaaggcctacagctccccgagcaccacccccgaggctcgccgccgggagccccaggccccgcgtcagccctcactgatgggccccgagagccagagccccgactgcaaagatggggccgcagccactggcgccacggccaccccctcggccggggccagcggggggctccagccgcaccagctgagcagctgcgatggggagctggccgtcgcccccctgccagagggggacctccccgggcagttcacacgcgtcatggggaaagtgtgcacacagctcttggtctccagacctgatgaggaaaatataagttcctatttacagctcatagacaagtgtctaattcatgaggcatttacagagacacagaaaaaaagattgttgtcatggaaacagcaggtgcagaagctctttcggtctttccctcggaaaacccttctagacatatcaggatatcgacagcaaagaaatcgaggctttgggcaatccaactccctcccgacggctggctctgtgggcggtggcatgggcagacggaacccgcgccagtaccagatcccctctcggaacgtcccttccgcccgcctgggcctcttgggcaccagtggattcgtcagctccaaccagcgcaacaccacagctacccccaccatcatgaaacaaggaagacagaacctgtggtttgccaaccccgggggcagcaatagcatgccaagccgcacccacagctcagtccagaggacccgctcgctgcccgtgcacacttccccacagaacatgctgatgttccagcagccagaattccagcttcccgtgaccgaacctgacatcaacaacaggctggagtcgttgtgcctcagtatgaccgaacacgccctgggagacggggttgaccggacctccaccatctagaagctgaagacgagagtgaccgcgctggccgtgaaatcgactgctgcgggtccagtgtccgccatcttcagggttgcacagaatcctccaagatactttgcagccttttttccccctggtccctctcccgttttgattttgtgagagcgtaggtcatcctcgtaaacatatcagtagacctggggttggttattttgtcatttgtttctgtcatgggatggtttggtgtgtggggtggggaggggtctctagggaattatgagactgggaggggggtggagggaatgcaggtagctctctggatggaacggggacaggggaaagagtactgccatgaaagagataggagacacataagaggacagcagaagccctggccctggggaggcttctcggaaggcctggcttcacaggcaggccacagaaggatatcgcgggcacgtgcacccaaagcaagatagtggcttcccttttatatccaatctaatcctgattggatgtccctgaggcccctgctggaaacagccataggagagggcccatggcagtaggggaaagaaggaagaaattccctgcaacaaaacttcagctaaactttgatttgtgtattgtttacataataattttaaagggtacataatgtgtaaagagtttggatagaacctctcttcatactatggttttcgtaaaggatctgttgttgttacggattcattttttccctctatttttataagagcagcagagttgtcttctcaaaacggctgccaagctctgcttcttgggaagatggatgcagtcatgtaggcctgagctgtccgtctttcaccgttaggtgggaggagcgtatgggtggacttgaaggacatggacgtggctggaatgagcacagcattgggtgagcgcacaaggatgaggacatcatgtgatcagttatgggtttgctcgcagggcacccagagattctcaaagaatcctgcagcctctttctgtgctggatttgcttgtcacggagaggcctccctccctttccaccccacccatggggcattatcctgtcactcccagccttgctccacacacacacaggtgggtacaagttccactggaggagaaaaggcaaggatggactttttccccttgtgagaggtttgatacccagaaaatgagctcaaaacctttacattagggttgcttgtaggaactggagcctggaggctgcatctacttcacctgtcactgctgagggagaggaggggagaaaggcccagcaacagcgtacagaggggtcagtcagcaagtccagagagcacatgcagggagatgtttggcccacaccgcacagccccgccatctccagtgggcgatgaaagatgtaggaaaggttgatttcaagatggaaatgacagcgctatccgcacagtatgaattagggatttgctgtgttagttgatttatccatccacacagaggggaggaaaaagacactcgttacttggtgggagattgagaaactgtggtacctaccacaaagtaatagctctgtttatgaagggcaagaaaggctacatttcagaatttgacacagtggagggtattagaggaaatcaaagaggagttgtgtggaaaatcaggttgtgtaaatgaaggtatgaatgctcagccagaggcaagatcagggagatggtacaaggcctgtttgttacatggatgagtcgggtgcctggttgtgtgtgtgtgtgtgtgtgtgtgtgtgtgtgtgtgaagtcagagttgaaattcagaagatcagactatggaaatcactgcccttttttttttaaaagctaatgaactacatacagacctaaaaggccttaatgaaatccgaacaattttcttttactttcaagatcaaaaacatgcacccaacccagccttggatgccaccaccaggtttttgaagcccttttgagtctaagaaggtgagaacaatgtaaccatagaaagcctttcgtgagcagagaaggcttgaatccacaatttcattcgctgaattaaaaaaaaaaggttcagacctctccttgggtgactaagttctaaagatgcaaatccatgtgcagaaagagatggcattttttagttgattatttttaaccaagtgccattaacattcatcccccacatcccttttctaaacaagcttagtgttacttggggaatgtgttgggatggacgatcacatgtaaggcaggaagaataggtcaaaggttgaaggccaaaggtaagaccagagggtttgcgaatgtgggtttgtaggatactgagaaagtgaataaagaggagaaaaaaccatggtattacacatcttgctgagaaaggaaagcattcggatctgctgcaaaaacacatatatccataaagactcatgttattcagaaaacagattgtgaacacaatcacattcgcatgaatcctttaaaaggaagaagaccttaaagtatctgcaaatctgaatttctatttattccttcactgaatatagaaacaatggttatctgattattagagatattattttggatatgttacttattaacttgctatggctggtaaccatgataaagtctgttattaataacaacataattctttttttaaagaagaaaagcttatttttcattgacagtgtatagatttatctacttagttgtgttttgctattagtgttttaattttttttttaagttgagtgtttgataaattttaagaccctgtccccaccttgttttgagtcctgtgttgactacaggtatatagctcaatttaaaaatcctaaagcaaaagaattttatttataaaagaatcaaacagttgcatgcatgaggctgtgaagtcagatatttagtaataaaagcagcagtgcctttttttgtatttacccattgacccccaccaaatgcaactgttttatattaagaaaatagtaacaattttaaaatctcagagtaaaatctatttcactacatgcttttccccccttgttctgatttaagcagtgtgtacttggcatctctacattgtcctagggacagtggtgttctacaatattatcatgtatgatgttttattggtgctttttattcatagtggcttcttaccagaaacagtaggaagaaacacatgaactgtgtacaagacatgaaacattgctgctgatatgttgttttttcacatgcttttgagttttcactttttaaacgagagccagcaagcaaaatagatgtggctgggtctgcctgtccgggcggctctttgcaccgagctctcaaatcctgtgtattgagggttcctttttggtactcaggattggagctacagctgggcccccctctctcccattcgtttgaagagacactgagggaaacaagggtttcttttgaggtgtccttggctgccttttacgggatgggagccttctccggatcttttgttcttctgcacctcttgtagctactgccggtgcaaggttgtagatgttattccccaggagcctgggcttgggggctgagctgggctgaatgcaaaagcatgcaaccagaaggcgggcaaggggaggaaaagcaggcctggcctcattggtcccctggagatgtctgtagcagtcagctccagcttgggcctggggaagcagcctgaccaaggcgctcaggtgtgcctgttacaagaagaacctgcagaaggataatttgcacatggagctgtgataacactaatgttgattttttttttttttacaagtcatcagagatgtttgcaaagtgagttttatttttttgtaattcctttatctttacttaaaggtgaatgtgtattcctctgggaggaataggaagaaaacaggaatgttaataatgtcgaacagaaaacttcctcccttattaatatataatcctcatgtatttatgcctaatgtaagctgacttttaaaaagctttcttttgttgcatgccctgtgcaggcatctgtattgtacatgcatgcctttcgtcctgttttcctgtataaagttagtgaacaaagaaatatttttgcctagttcatgttgccaagcaatgcatattttttaaatttgtcatatatggaaagagcatgtttgttacatgtaaaagctttactgatatacagatatactaatgtttgaagatgctgttctttgcaagtgtacagttttcaaatgttgttaccagtgaaacacccttgtggtttaaacttgctacaatgtatttattattcatttcctcccatgtaactaagaatcatggctatatttcatatcaacgttatattgaaagtgaagggaaatgattaatacaaggttttgtaaca

SEQ ID NO: 91 - DNA, 3833 bp, Homo sapiens
atttccggggacgccgcgccggactgaggctgtgcgcccgagactccgggtccccaggggctgcgccgggccggcctggcaagggggacgagtcagtggacactccaggaagagcggccccgcggggggcgatgaccgtgcgctgaccctgactcactccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggctctgaagagcggccattcctcagattcgaagctgaacacatctccaactacacagcccttctgctgagcagggatggcaggaccctgtacgtgggtgctcgagaggccctctttgcactcagtagcaacctcagcttcctgccaggcggggagtaccaggagctgctttggggtgcagacgcagagaagaaacagcagtgcagcttcaagggcaaggacccacagcgcgactgtcaaaactacatcaagatcctcctgccgctcagcggcagtcacctgttcacctgtggcacagcagccttcagccccatgtgtacctacatcaacatggagaacttcaccctggcaagggacgagaaggggaatgtcctcctggaagatggcaagggccgttgtcccttcgacccgaatttcaagtccactgccctggtggttgatggcgagctctacactggaacagtcagcagcttccaagggaatgacccggccatctcgcggagccaaagccttcgccccaccaagaccgagagctccctcaactggctgcaagacccagcttttgtggcctcagcctacattcctgagagcctgggcagcttgcaaggcgatgatgacaagatctactttttcttcagcgagactggccaggaatttgagttctttgagaacaccattgtgtcccgcattgcccgcatctgcaagggcgatgagggtggagagcgggtgctacagcagcgctggacctccttcctcaaggcccagctgctgtgctcacggcccgacgatggcttccccttcaacgtgctgcaggatgtcttcacgctgagccccagcccccaggactggcgtgacacccttttctatggggtcttcacttcccagtggcacaggggaactacagaaggctctgccgtctgtgtcttcacaatgaaggatgtgcagagagtcttcagcggcctctacaaggaggtgaaccgtgagacacagcagtggtacaccgtgacccacccggtgcccacaccccggcctggagcgtgcatcaccaacagtgcccgggaaaggaagatcaactcatccctgcagctcccagaccgcgtgctgaacttcctcaaggaccacttcctgatggacgggcaggtccgaagccgcatgctgctgctgcagccccaggctcgctaccagcgcgtggctgtacaccgcgtccctggcctgcaccacacctacgatgtcctcttcctgggcactggtgacggccggctccacaaggcagtgagcgtgggcccccgggtgcacatcattgaggagctgcagatcttctcatcgggacagcccgtgcagaatctgctcctggacacccacagggggctgctgtatgcggcctcacactcgggcgtagtccaggtgcccatggccaactgcagcctgtacaggagctgtggggactgcctcctcgcccgggacccctactgtgcttggagcggctccagctgcaagcacgtcagcctctaccagcctcagctggccaccaggccgtggatccaggacatcgagggagccagcgccaaggacctttgcagcgcgtcttcggttgtgtccccgtcttttgtaccaacaggggagaagccatgtgagcaagtccagttccagcccaacacagtgaacactttggcctgcccgctcctctccaacctggcgacccgactctggctacgcaacggggcccccgtcaatgcctcggcctcctgccacgtgctacccactggggacctgctgctggtgggcacccaacagctgggggagttccagtgctggtcactagaggagggcttccagcagctggtagccagctactgcccagaggtggtggaggacggggtggcagaccaaacagatgagggtggcagtgtacccgtcattatcagcacatcgcgtgtgagtgcaccagctggtggcaaggccagctggggtgcagacaggtcctactggaaggagttcctggtgatgtgcacgctctttgtgctggccgtgctgctcccagttttattcttgctctaccggcaccggaacagcatgaaagtcttcctgaagcagggggaatgtgccagcgtgcaccccaagacctgccctgtggtgctgccccctgagacccgcccactcaacggcctagggccccctagcaccccgctcgatcaccgagggtaccagtccctgtcagacagccccccggggtcccgagtcttcactgagtcagagaagaggccactcagcatccaagacagcttcgtggaggtatccccagtgtgcccccggccccgggtccgccttggctcggagatccgtgactctgtggtgtgagagctgacttccagaggacgctgccctggcttcaggggctgtgaatgctcggagagggtcaactggacctcccctccgctctgctcttcgtggaacacgaccgtggtgcccggcccttgggagccttggggccagctggcctgctgctctccagtcaagtagcgaagctcctaccacccagacacccaaacagccgtggccccagaggtcctggccaaatatgggggcctgcctaggttggtggaacagtgctccttatgtaaactgagccctttgtttaaaaaacaattccaaatgtgaaactagaatgagagggaagagatagcatggcatgcagcacacacggctgctccagttcatggcctcccaggggtgctggggatgcatccaaagtggttgtctgagacagagttggaaaccctcaccaactggcctcttcaccttccacattatcccgctgccaccggctgccctgtctcactgcagattcaggaccagcttgggctgcgtgcgttctgccttgccagtcagccgaggatgtagttgttgctgccgtcgtcccaccacctcagggaccagagggctaggttggcactgcggccctcaccaggtcctgggctcggacccaactcctggacctttccagcctgtatcaggctgtggccacacgagaggacagcgcgagctcaggagagatttcgtgacaatgtacgcctttccctcagaattcagggaagagactgtcgcctgccttcctccgttgttgcgtgagaacccgtgtgccccttcccaccatatccaccctcgctccatctttgaactcaaacacgaggaactaactgcaccctggtcctctccccagtccccagttcaccctccatccctcaccttcctccactctaagggatatcaacactgcccagcacaggggccctgaatttatgtggtttttatacattttttaataagatgcactttatgtcattttttaataaagtctgaagaattactgtttaatcctggctcttcctcttca

SEQ ID NO: 92 - DNA, 2281 bp, Homo sapiens
agcttccgcctggacccagcctcgtgggagccccgcgggtcctgcccagatgtggaagactgaggcctgttgaaagtgcagagctcagccctggcaccctctgttcccaagagctccatgcaggtgccacaggatggagaagaccttgctggccaaccttggtaccacggcctcctgtcccgccagaaggctgaagctcttcttcagcaaaatggcgacttcctggttcgcgcctctgggtcccgtgggggcaaccccgtgatctcctgccgctggcggggctcagccctccattttgaggtgttccgtgtggccctgcgtccccggccaggccgacccacagccctctttcaactggaggatgagcaattccccagcataccggctctggttcacagttatatgacaggcaggcgcccactgtcccaggccacaggggctgtggtctccaggcctgtgacttggcaggggcctctgcgacgcagctttagcgaggacaccctgatggatggcccagctcggatagagcctctcagggcaaggaagtggagcaacagtcagcctgcagatttggcacatatggggcggtcaagagaagaccccgctgggatggaagcctccaccatgcccatatctgccttgccccgaacgagcagtgacccggtgttgctgaaggcccctgctcccctgggaactgttgccgacagtctcagggcctccgatgggcagcttcaagccaaggcaccaacgaagcccccccggacaccctccttcgaactgcctgatgcctctgaacgtcccccgacgtactgcgagctggtgccccgagtgcccagtgtccagggaacatccccgagccaaagctgcccagagccagaggccccatggtgggaggccgaggaggatgaggaggaagagaatagatgttttacaagaccacaggctgagatctctttctgcccccatgatgccccctcctgcctgctgggcccccagaatcggcccctggaaccccaagtcctgcataccctccgtggcctgttcctggagcaccatcctgggagcaccgcccttcacctgctattggtagactgccaggccacaggcctcctgggagtgaccagagatcagcggggcaacatgggagtctcatctggcctggagctgctcactcttccccatggacaccacttgaggttggaactgctggagaggcatcagacactggcgctggccggggcgctggcggtgctgggctgctcggggccgctggaggagcgcgcagccgcactgaggggactggtagagctggcgctggcgctgcggccaggggcggcgggggacctgcccgggctggctgcagtcatgggcgccctgctcatgccccaggtgtcccggttggagcacacgtggcgccagctccgaaggagccacacggaggctgcgctggcctttgagcaggagctgaagccgctgatgcgggctctggatgagggcgctggaccctgcgaccccggcgaggtggcgctgccgcacgtggcacccatggttcgcctactggagggcgaggaagtcgcggggccgctggacgagagctgtgagcggctgttgcgcaccctgcacggggcgcgtcacatggtccgggacgcacccaaattccgcaaggtggcagcccagcgcctgcgaggattccggcctaacccggagctgagggaggccctgaccaccggcttcgtgcggaggctgctctggggtagccggggcgcgggagctccgcgcgctgaacgctttgagaagttccagcgcgtcctcggcgtcctgtcgcagcgcctggagcctgaccgctgagagcgcagacacccttcttcacacccgggacccccaggtttttgcgaaccccagaagagaccaaaggagtcgtcccaggctcctcgcgcctcaggtggaatcctgccctgtgcctcacagaagaggtggggaccgcagtcagggtcacctggaccatggtgaacatgtgacctgcagatctggcatcagaggccagagttcaaatgtgactccacctcttaaaagccgtgatttctagcagttgacttcacctctgtgtcggcctttaacaaaatcatagccatacagcagctcaggcctgtaatctcagcactttgggaggccgaggcggaaggaaggcttgaggccaggagttcaagaccagccagggcaacatggtgagacctcatctctacaaaaactgaaaaataaaaaacttttaaaaaatgtaaaa

SEQ ID NO: 93 - DNA, 2658 bp, Homo sapiens
gagagcgccgcccacccatccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaacatccacaagcggctgcaggcctgtctgcagggccagagcggggcagacatggacaagcgggtgaagaagcttcccctcatggctctgtccaccacgatggctgagagcttcaaggagctggaccctgattccagcatggggaaggccttggagatgagctgtgccatccagaatcagctggcccgcatcctggccgagtttgagatgaccctggagagggacgtcctgcagccactcagcaggctgagtgaggaggagctgccagccatcctcaaacacaagaaaagcctccagaagctcgtgtccgactggaacacactcaagagcaggctcagtcaggcaaccaagaattcaggcagcagtcaaggcctaggaggcagcccgggtagtcacagccatacgaccatggccaacaaggtggagacgctgaaggaggaggaggaggagctgaagaggaaagtggagcaatgcagggacgagtacttggctgacctgtaccactttgttaccaaggaggactcctatgccaactacttcattcgtctcctggagattcaggccgattaccatcgcaggtcactgagctcgctggacacagccctggctgagctgagggagaaccacggccaagcagaccactccccttcgatgacagccacccacttccccagggtgtatggggtgtcgctggcaacccacctgcaagagctgggccgggagattgccctgcccatcgaggcctgcgtcatgatgctgctttctgagggcatgaaggaagagggtctcttccgtctggctgctggggcctcggtgctgaagcgtctcaagcagacaatggcctcggacccccacagcctggaggagttctgctccgacccgcacgctgtggcaggtgccctcaagtcctatctgcgggagctgccagagcctctgatgaccttcgacctctatgatgactggatgagggcagccagcctgaaggagccaggggcccggctgcaggccctccaagaggtgtgcagccgcctaccccccgagaacctcagcaacctcaggtacctgatgaagttcctggcacggctggccgaggagcaggaggtgaacaagatgacacccagcaacatcgccatagtcctgggacccaacttgctgtggccacctgagaaagaaggggaccaggcccagctggatgcagcctccgtgtcttccatccaggtggtgggcgtcgtcgaggcgctgatccagagcgcagacaccctcttccctggagacatcaacttcaacgtgtcaggcctcttctcagctgttaccctccaggacacagtcagtgacaggctggcctctgaggaacttccgtccactgccgtgcccaccccagccaccaccccggctccggctccggctccagctccagctccggccccagccttggcttcagcagctaccaaggaaaggacagagtctgaggtgcctcccagaccagcctcccccaaggtcaccaggagtcccccggagacagctgccccagtggaggacatggctcggaggaccaagcgcccggcgccagcccggcccaccatgccgcccccccaggtctccggctcccgctcctcccctccagccccgcccttgccccctggctctggcagccctgggaccccccaagccctgccccgacgtctggttggcagcagcctccgagcccccacagtgccacccccgttaccccccacaccccctcagcctgcccggcgccaaagccggcgttcaccagcctcccccagcccggcctccccaggtccagcctcccccagcccagtctctttgagtaaccctgcacaggtggacctgggggctgccacagcagagggaggagcccctgaggctatcagtggggtccccactcccccagctatcccccctcagccccgccccaggagccttgcctcagagaccaactgagtggctggtttctccctaagcagccctcagcaccccctccctccccacctggccctcccaggacagctctcgccccccacaaaggggcatgggcctccagcctttgcccacaagtgcctcagtgcccactgggtcggcccccatggccaggagggctcaggacaatcctctatttcctgaccttttcctcgtccaccctgggcttggggacccccccaccggactctccactctccggcaggtcctaggggagccaccggaaggaaggagaggtttgcctgctcctacgggactgattcttctcttgccgacatgttttttgtaaggctggtaaataaattattttggacaaaactggagcagctgcccaaatgatagttttattttctgtccttgaaataaagaagccaattttataaaggggaaaacaata

SEQ ID NO: 94 - DNA, 11264 bp, Homo sapiens
ccgggagtccgggcagcgttcggcgcgccgggccggggtggcgggcggccccgggaccccggcagctggagaaggagccggagcccggccgggatgagaaggtgacgccgccgggggcgccactcgctttgtgggggaagatgctcgcctactgcgtgcaggatgccaccgtggtggacgtggagaagcggaggaacccctccaagcactacgtatacataatcaatgtgacctggtctgactccacctcccagactatctaccggaggtacagcaagttctttgacctgcagatgcagcttttggataagtttcccattgaaggtggccagaaggaccccaagcaaaggatcatccccttcctcccaggcaagatcctcttccgcagaagccacatccgggacgtagctgtgaagagactgaagcccatcgatgaatactgccgggcacttgtccggctgcccccccacatctcacagtgtgacgaagtcttccggttcttcgaggctcgacccgaggatgtcaaccctccaaaagaggactatggcagttccaagaggaaatcagtgtggctgtccagctgggctgagtcgcccaagaaggacgtgacaggtgccgacgccaccgccgagcccatgatcctggaacagtacgtggtggtgtccaactataagaagcaggagaactcggagctgagcctccaggccggggaggtggtggatgtcatcgagaagaacgagagcggctggtggttcgtgagcacttctgaggagcagggctgggtccctgccacctacctggaggcccagaatggtactcgggatgactccgacatcaacacctctaagactggagaagaggagaagtatgtcaccgtgcagccttacaccagccaaagcaaggacgagattggctttgagaagggcgtcacagtggaggtgatccggaagaatctggaaggctggtggtatatcagatacctgggcaaagagggctgggcgccagcatcctacctgaagaaggccaaggatgacctgccaacccggaagaagaacctggccggcccagtggagatcattgggaacatcatggagatcagcaacctgctgaacaagaaggcgtctggggacaaggaaactccaccagccgaaggcgagggccatgaggcccccattgccaagaaggagatcagcctgcccatcctctgcaatgcctccaatggcagtgccgtgggcgttcctgacaggactgtctccaggctggcccagggctctccagctgtggccaggattgcccctcagcgggcccagatcagctccccgaacctacggacaagacctccaccacgcagagaatccagcctggggttccaactgccaaagccaccagagcccccttctgttgaggtggagtactacaccattgccgaattccagtcgtgcatttccgatggcatcagctttcggggtggacagaaggcagaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaagcaggagagcgggtggtggtatgtgaggtttggggagctggagggctgggccccttcccactatttggtgctggatgagaacgagcaacctgacccctctggcaaagagctggacacagtgcccgccaagggcaggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttccccagctgggcagggctggaagccttacgtatgaagcatggagaagcagccattgtccccactatgggcagaggggggacccggctggccccttgggtcagactggagccaacaccgccagccaccccctctggcctgctggcaatgccacaggtgcccaagaagatggaggatccctgtgccaggagccaacctggtcttcccgagggtcagtgccccagtgaagacagaagcgagagaataaagttccctgtaggtcctctgtcacctttgggttgtgtttttcaattgttgacatttcagaggggaccctccagaagcccagccggcttcccccaaggactcccccttcgctgggagtggatttccacacgtgcctttgatttcggacagattgggcctcacagccaccgattcagctgccagggtccctggactgggggttggtgttttctatagaggaggaaaggccctccctcaccctgctccccacccaggcagggcagcatgggacccagtgtctcagtgccttcaaaacccacccccacccctaccctaccccaccacaccccatcccagaggccttgcctgggcaaccctaagcccctgtccctcgccatacactgatgcctggcagctagagcaaatggctcgtgttctttgtcgaaggcctgtggtgagattgttttgtttccttttgttttgtgagtttgtttaaaattgaaattagttattttcttctgctggacagtattaaatagagcaggatgttgagttaatctgctagattgcagtactaatggtagtggtttagtgtcttcatgttaatattatttgtacttatttgaacaataatgataaagaagtggttcattattttttaattaatgcactttaaataaggtagaatggaaaaaacccagagagcaaagtgcattacttaaagatgcagtatatacttttctcatttttaaacagcacatatttattaagagaaaaaaagtaatttatgactatttaaaataaaatttaaaagtagagtgactgtcaggtaaagaaccttcaatgtagctatcttccagggggagggccctgcagcctcgctcctcagatgtctgcactgagccagttcagtcactagtgcgccagccaggccaggagggagtgcagagcatgtctgccaagcacagagcatctcagttggactggaccacagtgctcccgagagcctgcctttcctgcccttccccaccacctgcactgccccccacattctcccagccccccccaaggaccccctctccttgacccccagtgctgtaagtaatagagtcattaaaatgcaggactgaaagagacctcagaggtctctatcccatcccttcctgttactgcggcccaaggacaggaaacaacttttccaaaatcccacagctagttaatgacagatctccccactacattaatcccgtgctcctcctcactgccattatagtttattgtgtggtcatgtttacattgtgacatccagccccaaggatggctgggagttgctcaggcatccaggaaaagtggggaatgctgccatctggtgacagcatgtagatttgggcagtgaacagggattgccatgccccagtcttcgcacctcgccccctcaccccctaactcacagcacaaaccctgcaaacccaaagagaatattaatacttgaagcaagaagggtgcatgccagtccttctccgacatggccagggggtaccaggccttgtgcgcctggcctcctagccctagccagggcgagagggcctttcccttgagctactgagctgctttgtgatgctgaaggatactgccggcagcaggcagaggagggagggggcctagggctctgacccatctggaggaaaaccagatcggactaaaaaaggaaaaagaaaaacaaaatctccgcagtgtccaaacctagtttcccatgagttgcgactgaaaatgtgaaacgacactgtattgctgtatactgcaactttaaccataatgagcccttctgaggtcattattgaggttcatataatgcccgaagatgcagcatttggtgctttgttttcctttccgtttcaagacctttttcttttattgcaaggggaaaaaaatgtcatctccccccacctcatccctctttgtgacagcagacctggctgtgttgcccctctcctcctcactattctcaccaggccatgggactttgggggcagtgagagagagctggaaaggggcaaccctgagcagcaggtgtgccccatgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaagacaggatcagtgacccacagctttggggaaaaacagccccactgttaacttccctcctgcaaacctgggtccccaggccataaggtgggcacactggtgcttacagactgggtggagagccctaccttccaaggtcttgatcccagcctgcctataaggttgggattagcatgcaatcccccttccccaatcctgtctttttaaaatctcaagtttgcacttaaccttgacaacagcaccctctcctactccagtcctagaactcagtggccttagagaatggggtcccctgcactgaaggtccccgccttgctcccagttccatcctggccaataggctgcgcctcaagaggtgaaagagaaaaaagggagggagggaggaagaattatttagaacaaaaggatggctcgagcacgttagaggcaagtgagaggcacgttggtgagaagagcatgtgcatgtttggggtagctggggcctactgtcccttcattagggaaggaggcttccagaagcggatgtcttctagaaagaaaaattgtgtgaaggctgaaaaggggcttggagttttgtctttgttgattagaaagaaggaagaagtcagctctgagtgtttcaggaagaagagagcaggtagaaagggaatttagtgatttaacacccaagggtccagccatagcaggttggaaaatcctccaaatttggccacagaaactggctaggaaaaaactgccactcattgggccacacgctgggtccccatcagttctcaatgaatggtcattgatttacttagcagagagaagtcaccagccacaaaccaatctttgagtttgcaggccctgattccagaatatatgcatccagctcccgggttctcagctggttttgcccacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaaaaaaaaaaaaaaaaaaa

SEQ ID NO: 95 - DNA, 3936 bp, Homo sapiens
actcgctcgtccccggcttccgagcacagcatggcggtcaaggtgcagacaactaagcgaggggatcctcatgagttaagaaacatatttctacagtatgccagtactgaggttgatggagagcgttatatgaccccagaagactttgttcagcgctatcttggactgtataatgatccaaatagtaacccaaagatcgtgcagctcttggcaggagtagctgatcaaaccaaggatgggttgatctcctatcaagagtttttggcatttgaatctgttttatgtgctccagattccatgttcatagtggctttccagttgtttgacaagagtggaaatggagaggtgacatttgaaaatgtcaaagaaatttttggacagactattattcatcatcatatcccttttaactgggattgtgaatttatccgactgcattttgggcataaccggaagaagcatcttaactacacagaattcacgcagtttctccaggagctgcaattggaacatgcaagacaagcctttgcactcaaagacaaaagcaaaagtggcatgatttctggtctggatttcagtgacatcatggttaccattagatctcacatgcttactccttttgtggaggagaacttagtttcagcagctggaggaagtatctcacaccaggttagcttctcctacttcaatgcatttaactcgttactgaataacatggagcttgttcgtaagatatatagcactctagctggcacaaggaaagatgttgaagtcacaaaggaggaatttgcccagagtgccatacgctatggacaagtcacaccactagaaattgatattctatatcagcttgcagacttatataatgcttcagggcgcttgactttggcagatattgagagaatagccccattggctgagggggccttaccttacaacctggcagaacttcagagacagcagtctcctgggttaggcaggcctatctggctccagattgccgagtctgcttacagattcactctgggctcagttgctggagctgtgggagccactgcagtgtatcctatagatctggtgaagacccgaatgcaaaaccagcgtggctctggctctgttgttggggagctaatgtacaaaaacagctttgactgttttaagaaagtcttgcgttatgagggcttctttggactctacaggggtctgataccacaacttataggggttgctccagaaaaggccattaaactgactgttaatgattttgttcgggacaaatttaccagaagagatggctctgttccacttccagcagaagttcttgctggaggctgtgctggaggctctcaggtcatttttaccaacccattggagatagtgaagattcgtctgcaagtagctggagagatcaccacgggacccagagtcagcgccctgaatgtgctccgggacttgggaatttttggtctgtataagggtgccaaagcgtgtttcctccgagacattcccttctctgcaatctattttcctgtttatgctcattgcaaactacttctggctgatgaaaatggacacgtgggaggtttaaatcttcttgcagctggagccatggcaggtgtcccagctgcatctctggtgacccctgctgatgtcatcaagacaagactgcaggtggctgcccgcgctggccagacgacatacagtggtgtcatcgactgtttcaggaagattctccgggaagaagggccctcagcattttggaaagggactgcagctcgagtgtttcgatcctctccccagtttggtgttaccttggtcacttatgaacttctccagcggtggttttacattgattttggaggcctcaaacccgctggttcagaaccaacacctaagtcacgcattgcagaccttcctcctgccaaccctgatcacatcggtggatacagactcgccacagccacgtttgcaggcatcgaaaacaaatttggcctttatctcccgaaatttaagtctcctagtgttgctgtggttcagccaaaggcagcagtggcagccactcagtgatgagacaactgttgagtgtggcaaaatggcgccttgaagaaagaggcctaggagagcagccctgtaatgtatccagtcagctgcatggtactgactgagctgaggagtcaaactcttctttctgtatgacatatacatatacttgtttataaaataatcatttgcccagggaaaaaaccacaacgctgtttcaagctttagtcttatgtgttgaaatgtttttgtaagccttggcatgaattagtgttctagactctgctttgcacagcttgcacttacagtgattgtacatattgtacatctttgtacagagacatcttggcacctcatcccaacaaatcacatttgtagaaatgtaatgcggttctgagtggcttgaaatgtacagaatgttttgaaagtgttttattaagaatcacacaaaaataaatgtattaaaattaaattcattctcttattggtgacttatggaaataaagcatcaatattggatgtatttaattcctagtttgttttccattctggaataaaaaggtatttgctgataaaaggcataacgagacatagtgctgctaccactgaataagtgatactttggaaagatgcatgccagtggatgccagaggaccaggctaatgacttgtgtgtgctgatgtgtttccatttgtatttaatgtgtgtagaccctcctctgttcatcaatcaaaaagcatttcctaggcagctcctcgcctgtcagtgtgcatatggaaacagggacatctccatcattactggcttagttttgctttcctttgacacagtaaggcaaaggccaagctttcaaaagagtaaaggatactttcacaatttcccttcatatggatatgattccagtcaaaaataaaatgcacaccaaaatgtatacatgtagttggatttttctttgtaaatatactgataatactttttgttctgattgactactgattgcaaataactcatgatcgggttcgccctttcttccacctttatagaaaacagaaaaattagttttagaaagggctagcgcagagtgaagggagggaagaagaaagagaagaaaagctctatatggtgatttagtggggtctaggttcttactttggaatccaaatgcaaactgttctaaaagtcactcatcaagggcgtgattactaatttggatctaaacatagatcttgacagccacatctacactttgatatggatgtgatttgatgtgcagtatcagaatttatttaccttaccaaagtgctctgggaagacattattgctactgccagtaagctgggatatgagaatgtatgcaaatattttcaagaggcgagcctggagacagaccaagttacttagtatcctgcacagtgctcctcgattgatggctgacagccctgtgactgcaactgtaggctccctggaggccctccaggaacaaaagaattagctttgaaagcaagttattttcaaatgtattagattggtctcatgggagtggaacaaataataatacagttgttttgctactaccacttgttagaaatatataagtagtccatggatatgtgattacaaaagaatcctatgtatgtatctagagtgagatgggaaagtgtcccgcttaccctccttctacctccaccacttcctggcccagaggtaatcactgctaacaggttacagcatgaatatgtagtctgtttttcataactctatagaaatatatgtacatatttatattttagaaacaggattatgttatgtgtgtgttattctgtgtcttgcttttgttcacttaatgtgttttggatatctttccatgtcagtttataaagttttatttttaatggc

SEQ ID NO: 96 - DNA, 9737 bp, Homo sapiens
actgaatggagagagcgagcgccggccagctcacccggccgccccgtgccccagccgcagccgccgcgctccccagcccagccccaagccggacctccccgggcgccacgccccattgcgctcgccccaggtccccaacccggcccgcgggccagcggggccagggggcgctccgcacctgggcactcccagcgatgcgcagcggggcagcgccggccccgccgatggagctgctgttgctgccgccgccgccgcccggagcgccccgctccgcccgcgccccgtgcgcctgagcaccgagctcgcccctcctccgcgctaactccgccgcccgctccccaggccgcccgcgctccccgcgcgcctcctcgggctccacgcgtcttgccccgcagaggcagcctcctccaggagcggggccctgcacaccatggcccccgggtgggcaggggtcggcgccgccgtgcgcgcccgcctggcgctggccttggcgctggcgagcgtcctgagtgggcctccagccgtcgcctgccccaccaagtgtacctgctccgctgccagcgtggactgccacgggctgggcctccgcgcggttcctcggggcatcccccgcaacgctgagcgccttgacctggacagaaataatatcaccaggatcaccaagatggacttcgctgggctcaagaacctccgagtcttgcatctggaagacaaccaggtcagcgtcatcgagagaggcgccttccaggacctgaagcagctagagcgactgcgcctgaacaagaataagctgcaagtccttccagaattgcttttccagagcacgccgaagctcaccagactagatttgagtgaaaaccagatccaggggatcccgaggaaggcgttccgcggcatcaccgatgtgaagaacctgcaactggacaacaaccacatcagctgcattgaagatggagccttccgagcgctgcgcgatttggagatccttaccctcaacaacaacaacatcagtcgcatcctggtcaccagcttcaaccacatgccgaagatccgaactctgcgcctccactccaaccacctgtactgcgactgccacctggcctggctctcggattggctgcgacagcgacggacagttggccagttcacactctgcatggctcctgtgcatttgaggggcttcaacgtggcggatgtgcagaagaaggagtacgtgtgcccagccccccactcggagcccccatcctgcaatgccaactccatctcctgcccttcgccctgcacgtgcagcaataacatcgtggactgtcgaggaaagggcttgatggagattcctgccaacttgccggagggcatcgtcgaaatacgcctagaacagaactccatcaaagccatccctgcaggagccttcacccagtacaagaaactgaagcgaatagacatcagcaagaatcagatatcggatattgctccagatgccttccagggcctgaaatcactcacatcgctggtcctgtatgggaacaagatcaccgagattgtcaagggactgtttgatgggctggtgtccctacagctgctcctcctcaatgccaacaagatcaactgcctgcgggtgaacacgtttcaggacctgcagaacctcaacttgctctccctgtatgacaacaagctgcagaccatcagcaaggggctcttcgcccctctgcagtccatccagacactccacttagcccaaaacccatttgtgtgcgactgccacttgaagtggctggccgactacctccaggacaaccccatcgagacaagcggggcccgctgcagcagcccgcgccgactcgccaacaagcgcatcagccagatcaagagcaagaagttccgctgctcaggctccgaggattaccgcagcaggttcagcagcgagtgcttcatggacctcgtgtgccccgagaagtgtcgctgtgagggcacgattgtggactgctccaaccagaagctggtccgcatcccaagccacctccctgaatatgtcaccgacctgcgactgaatgacaatgaggtatctgttctggaggccactggcatcttcaagaagttgcccaacctgcggaaaataaatctgagtaacaataagatcaaggaggtgcgagagggagctttcgatggagcagccagcgtgcaggagctgatgctgacagggaaccagctggagaccgtgcacgggcgcgtgttccgtggcctcagtggcctcaaaaccttgatgctgaggagtaacttgatcggctgtgtgagtaatgacacctttgccggcctgagttcggtgagactgctgtccctctatgacaatcggatcaccaccatcacccctggggccttcaccacgcttgtctccctgtccaccataaacctcctgtccaaccccttcaactgcaactgccacctggcctggctcggcaagtggttgaggaagaggcggatcgtcagtgggaaccctaggtgccagaagccatttttcctcaaggagattcccatccaggatgtggccatccaggacttcacctgtgatggcaacgaggagagtagctgccagctgagcccgcgctgcccggagcagtgcacctgtatggagacagtggtgcgatgcagcaacaaggggctccgcgccctccccagaggcatgcccaaggatgtgaccgagctgtacctggaaggaaaccacctaacagccgtgcccagagagctgtccgccctccgacacctgacgcttattgacctgagcaacaacagcatcagcatgctgaccaattacaccttcagtaacatgtctcacctctccactctgatcctgagctacaaccggctgaggtgcatccccgtccacgccttcaacgggctgcggtccctgcgagtgctaaccctccatggcaatgacatttccagcgttcctgaaggctccttcaacgacctcacatctctttcccatctggcgctgggaaccaacccactccactgtgactgcagtcttcggtggctgtcggagtgggtgaaggcggggtacaaggagcctggcatcgcccgctgcagtagccctgagcccatggctgacaggctcctgctcaccaccccaacccaccgcttccagtgcaaagtactctggttttgctgcccagggccagtggacatcaacattgtggccaaatgcaatgcctgcctctccagcccgtgcaagaataacgggacatgcacccaggaccctgtggagctgtaccgctgtgcctgcccctacagctacaagggcaaggactgcactgtgcccatcaacacctgcatccagaacccctgtcagcatggaggcacctgccacctgagtgacagccacaaggatgggttcagctgctcctgccctctgggctttgaggggcagcggtgtgagatcaacccagatgactgtgaggacaacgactgcgaaaacaatgccacctgcgtggacgggatcaacaactacgtgtgtatctgtccgcctaactacacaggtgagctatgcgacgaggtgattgaccactgtgtgcctgagctgaacctctgtcagcatgaggccaagtgcatccccctggacaaaggattcagctgcgagtgtgtccctggctacagcgggaagctctgtgagacagacaatgatgactgtgtggcccacaagtgccgccacggggcccagtgcgtggacacaatcaatggctacacatgcacctgcccccagggcttcagtggacccttctgtgaacaccccccacccatggtcctactgcagaccagcccatgcgaccagtacgagtgccagaacggggcccagtgcatcgtggtgcagcaggagcccacctgccgctgcccaccaggcttcgccggccccagatgcgagaagctcatcactgtcaacttcgtgggcaaagactcctacgtggaactggcctccgccaaggtccgaccccaggccaacatctccctgcaggtggccactgacaaggacaacggcatccttctctacaaaggagacaatgaccccctggcactggagctgtaccagggccacgtgcggctggtctatgacagcctgagttcccctccaaccacagtgtacagtgtggagacagtgaatgatgggcagtttcacagtgtggagctggtgacgctaaaccagaccctgaacctagtagtggacaaaggaactccaaagagcctggggaagctccagaagcagccagcagtgggcatcaacagccccctctaccttggaggcatccccacctccaccggcctctctgccttgcgccagggcacggaccggcctctaggcggcttccacggatgcatccatgaggtgcgcatcaacaacgagctgcaggacttcaaggccctcccaccacagtccctgggggtgtcaccaggctgcaagtcctgcaccgtgtgcaagcacggcctgtgccgctccgtggagaaggacagcgtggtgtgcgagtgccgcccaggctggaccggcccactctgcgatcaggaggcccgggacccctgcctcggccacagatgccaccatggaaaatgtgtggcaactgggacctcatacatgtgcaagtgtgccgagggctatggaggggacttgtgtgacaacaagaatgactctgccaatgcctgctcagccttcaagtgtcaccatgggcagtgccacatctcagaccaaggggagccctactgcctgtgccagcccggctttagcggcgagcactgccaacaagagaatccgtgcctgggacaagtagtccgagaggtgatccgccgccagaaaggttatgcatcatgtgccacagcctccaaggtgcccatcatggaatgtcgtgggggctgtgggccccagtgctgccagcccacccgcagcaagcggcggaaatacgtcttccagtgcacggacggctcctcgtttgtagaagaggtggagagacacttagagtgcggctgcctcgcgtgttcctaagcccctgcccgcctgcctgccacctctcggactccagcttgatggagttgggacagccatgtgggaccccctggtgattcagcatgaaggaaatgaagctggagaggaaggtaaagaagaagagaatattaagtatattgtaaaataaacaaaaaatagaacttatttttattatggaaagtgactattttcatcttttattatataaatatattacaccatctgcgtatatgtaccatatagtgagttatttttaccaagttttgtgttgtgtatttgttgtgtttttaaaaatagctgtttaaaaatttaagaaaaaaatagactaataaaaatgctttaaaacaaaaggataagaataaagaatgatagcctgtctgaggaaggaggaagatgttttcatgtttatgaaacggtattatgtcggcagtagaccaagagctgctcattgagatcagaaaaaggaataagaggaagagagagaaggaaaagacctttgtttcttgttttttaactcccttttatttttcctcccctaaaattacccagcttttcggagtcctggatgtcagtgcccaaaatgcccagttcttccaggaaaagctgctgagccctggccttctcagtctcactgccactcaaaaatattgctgtccctgtctgtcccagaccccccttcagggtatctgaacccactgggggacccctcttctccttcctgggtggccctggcttccgtatctgaacccactgggggacccctcttctccttcctggctggccctggcttccaatcgaggactgactattgaagtctgctacaggtgtcatttggaactgtcttaccaaattttaaaacagctgctatttttcctgctcctccccaggagaggggtcttcctagaggaggcgagggaagagaatatcatggtgtctcctcaggacccatgcactggccctctctcctccttccaggtaatttttcattggaatgtatcccagtagagaaggtagtcagcccttcttggaagcggaaggctgggagccaagtcaagtctgcccacagcgctagatgtccaactctggaaggttcttggaggctcttgttgtaagacaggcctctgccacctgatcctccaggtcaccagcatgacgatagagactccttgcccatctgtgacactttccaatgcatatccaaactttaccttattttatctatgcaacccctgcctccctgggaaggataagggagtagagctgggttcactaagaaggaagtttaggccctcacaggctctggaacttgccttaagccacacaccagataagtggaggagccagaccagaagtccagacccaaagcttgagattcttcctctagaatgggtgagcacaggtgattcaggcggcttaaatccatcagagcagccctgccggaaaaggaaataatatgatgttttttcctgctcttgttctgccttgctcactccttctccctccgcagtatctggaaagattctggagaccagggcttatgcatctagggaaagtgaccaagggcagcctatccagcctctgcctccattcctgaaggggacttccctgcccctgtttctttccatgtctctccctccctcactcccatttgcccccttccaccccatcaggttagccacatatcttccagggctcagctgttcacaccaactccctggctcttatcatccatccctccttcccccaggagcttccactgtaggagtttcagggagaagagtttggaattcattggacctttcagccctcaggttccctagaggagcctagttgatctgtgagtaccaatggtgggccaaagacgcagggaataatgaagggagaaagaaaagaaaggaagatggaggaaaacgaggcaactggaagaaggaaggaaggaaagaaggaagggatggaggggatgaagagaagggagagagggatatagctgaggaatttatctaaaaatgtgcatgtaaatctccattatgttccaggtactgtgccttatgatggctttgttttttgttgtcattagagacaaggtcttgctttgtcacccaggctggagtagagtggttcgatcatagctcaccgcagcctcaacctcctaggctcaagccatcttcctgcctcagtctcccaaaatgctgggattacaggtgtgagccactatgctcagcctgtttcaaacattattataatagcagatttatttagtactttattatacatcagataccactctaattgtgaaatagatatatattcatttaattattgaaacaaccatgtagttaaaacactattaactcattttacagttgagtagactgagacacagagaagttaaagaacttgcccaagagtaaatgtctaataaaccgtagagccaggatctgggcccaggctgtctgactccagaacttgctcactcaaccactaaaccatcctgcttctcatgggaaagaaacacatcctgcctttgaggatcctacagcctgtgacaaaaacagtcataaaaatggacaattgccttattacacaaggagctcttaagtggcaatacaagcaatggaagtggctgtccagaggagggaacttctagtcctaggtctttaaggatgaataggagtttgccagagtgagaaagggaattgaactttcctgggagtggccttttaaaaagcaatgagatatggccaggcctggcttgtttggggaagagtcaaaatctagggtggcaagagtatgggaagcacactgaggagcagagagaaatggggtaggtaggaaggtagggttttgaccacaaagagctgtgcatgctaaactgggccacaggtgccagcagggttgtttgaggaagggaagagcaagacaagctctggtttaggaagagagctgtggcagcataaaggcctgaaagaggagacagagctgtcacccaaaatggacttgagagctccctgtggtttactctgtggctagaaaacactgccggccagatggatcacaaatgtctatggtagcttagaagctctgctcttgaagaggatcctgggatctgcccaacacccttcccaacctccatttccccatccccacctccattgccccatcccccctctccccctaggcaggtggatctgagccttatcccaccaccaatgcccctgctagcctctccccacccagcccagagcctactcagcctgccatctcaagagccccaccgagggtcactggcttcctgggaggagtcaccaggctgccagctttccctctgcctccccaaggaacctgagacctccctctgctcatcaccctgggcccaatcctgaatccagcccccatcaaccaagacagcaaaagggccaggtctgtcccttataattttgagccttctccctcaagtttggaagccctgactttaagaaatgccaaatgcaaggaccattaagaaaattctccccgaaatgaggctcctctaacaaatgatgattaaaacgctctctccttgagcagtcacattctagaaacaggacattccatgaggcaggaagagttcagttaatttgctcctgaaaaagtgtggttcagtgtttgtgtggcaatgtacgtgggcagaagaggccgctcaagctgtgtcccccctgagcaggattcaggaaagggaaaagaagttctcttcaactcagccaaggggccgtacgatggccgatgagattatgtatttaaaagttctttgtaaagtgtaaactaaaaaccttaaatgtaagatgctgttgttattattactgttgttgttgctgttatggacatgccaaaaggcccttgttagaagacagttttgccttttcaatctcatagcaaggaactcaagtctgatgcttcaaaaagatgagaagaagggcaagaagagggataactcccaagctcagagggaaaaaaaaggtgggggaaaagagccccagggtgaccttcaggaaaggccaggaccaggatgatctaacctttcccttcaccagaaacaaagctattgccagactgaaccctaaagtcaagcagtcacccactgcctttgctgggagcagaagcccatagcaacaagtgacctgcccctcagactcaagatcccagataccagagctggaggagtcatagggcattactggtaggcaggaaaactgagggtcgaacaaatggaagaatgcggtgatcatagaccaaagacacacagataattaaccccatgtgtccacccaggccaaagttcttcctgctaccccacagtggatgtccaggcagatggtccccacatgatggggaagcagagggcatagtgtggttttgtgggacttgttcatgttttgtagtgtgggctcaacagtgccaaaggaaacactagggaaaagttggtgaaacatgccagctagcaggaccagtaaaggcataatcaggcatttggcaaagcttgcttttctaattcaatgataggttctaataggaaatttttgaagattttttaaaacaatgttatagtggcacttccccagtatggaataaataacatgcattcttttttcaatatactgtcatattcagatgtcattaaaataaatggatgagtcacagaggagctatcagatgctctcatgactaccataactca

SEQ ID NO: 97 - DNA, 4249 bp, Homo sapiens
ctctttatttacgcctacctcccagcccttggcaatctgactaataacaaactgagctaacaagaaatactagaaaaggaggaaggagaacattgctgtagcttggatctacaacctaagaaagcaagagtgatcaatctcagctctgttaaacatcttgtttacttactgcattcagcagcttgcaaatggttaactatatgcaaaaaagtcagcatagctgtgaagtatgccgtgaattttaattgagggaaaaagggacaattgcttcaggatgctctagtatgcactctgcttgaaatattttcaatgaaatgctcagtattctatctttgaccagaggttttaactttatgaagctatgggacttgacaaaaagtgatatttgagaagaaagtacgcagtggttggtgttttcttttttttaataaaggaattgaattactttgaacacctcttccagctgtgcattacagataacgtcaggaagagtctctgctttacagaatcggatttcatcacatgacaacatgaagctgtggattcatctcttttattcatctctccttgcctgtatatctttacactcccaaactccagtgctctcatccagaggctcttgtgattctctttgcaattgtgaggaaaaagatggcacaatgctaataaattgtgaagcaaaaggtatcaagatggtatctgaaataagtgtgccaccatcacgacctttccaactaagcttattaaataacggcttgacgatgcttcacacaaatgacttttctgggcttaccaatgctatttcaatacaccttggatttaacaatattgcagatattgagataggtgcatttaatggccttggcctcctgaaacaacttcatatcaatcacaattctttagaaattcttaaagaggatactttccatggactggaaaacctggaattcctgcaagcagataacaattttatcacagtgattgaaccaagtgcctttagcaagctcaacagactcaaagtgttaattttaaatgacaatgctattgagagtcttcctccaaacatcttccgatttgttcctttaacccatctagatcttcgtggaaatcaattacaaacattgccttatgttggttttctcgaacacattggccgaatattggatcttcagttggaggacaacaaatgggcctgcaattgtgacttattgcagttaaaaacttggttggagaacatgcctccacagtctataattggtgatgttgtctgcaacagccctccattttttaaaggaagtatactcagtagactaaagaaggaatctatttgccctactccaccagtgtatgaagaacatgaggatccttcaggatcattacatctggcagcaacatcttcaataaatgatagtcgcatgtcaactaagaccacgtccattctaaaactacccaccaaagcaccaggtttgataccttatattacaaagccatccactcaacttccaggaccttactgccctattccttgtaactgcaaagtcctatccccatcaggacttctaatacattgtcaggagcgcaacattgaaagcttatcagatctgagacctcctccgcaaaatcctagaaagctcattctagcgggaaatattattcacagtttaatgaagtctgatctagtggaatatttcactttggaaatgcttcacttgggaaacaatcgtattgaagttcttgaagaaggatcgtttatgaacctaacgagattacaaaaactctatctaaatggtaaccacctgaccaaattaagtaaaggcatgttccttggtctccataatcttgaatacttatatcttgaatacaatgccattaaggaaatactgccaggaacctttaatccaatgcctaaacttaaagtcctgtatttaaataacaacctcctccaagttttaccaccacatattttttcaggggttcctctaactaaggtaaatcttaaaacaaaccagtttacccatctacctgtaagtaatattttggatgatcttgatttgctaacccagattgaccttgaggataacccctgggactgctcctgtgacctggttggactgcagcaatggatacaaaagttaagcaagaacacagtgacagatgacatcctctgcacttcccccgggcatctcgacaaaaaggaattgaaagccctaaatagtgaaattctctgtccaggtttagtaaataacccatccatgccaacacagactagttaccttatggtcaccactcctgcaacaacaacaaatacggctgatactattttacgatctcttacggacgctgtgccactgtctgttctaatattgggacttctgattatgttcatcactattgttttctgtgctgcagggatagtggttcttgttcttcaccgcaggagaagatacaaaaagaaacaagtagatgagcaaatgagagacaacagtcctgtgcatcttcagtacagcatgtatggccataaaaccactcatcacactactgaaagaccctctgcctcactctatgaacagcacatggtgagccccatggttcatgtctatagaagtccatcctttggtccaaagcatctggaagaggaagaagagaggaatgagaaagaaggaagtgatgcaaaacatctccaaagaagtcttttggaacaggaaaatcattcaccactcacagggtcaaatatgaaatacaaaaccacgaaccaatcaacagaatttttatccttccaagatgccagctcattgtacagaaacattttagaaaaagaaagggaacttcagcaactgggaatcacagaatacctaaggaaaaacattgctcagctccagcctgatatggaggcacattatcctggagcccacgaagagctgaagttaatggaaacattaatgtactcacgtccaaggaaggtattagtggaacagacaaaaaatgagtattttgaacttaaagctaatttacatgctgaacctgactatttagaagtcctggagcagcaaacatagatggagagtttgagggctttcgcagaaatgctgtgattctgttttaagtccataccttgtaaataagtgccttacgtgagtgtgtcatcaatcagaacctaagcacagcagtaaactatggggaaaaaaaaagaagaagaaaaagaaactcagggatcactgggagaagccatggcattatcttcaggcaatttagtctgtcccaaataaaataaatccttgcatgtaaatcattcaaggattatagtaatatttcatatactgaaaagtgtctcataggagtcctcttgcacatctaaaaaggctgaacatttaagtatcccgaattttcttgaattgctttccctatagattaattacaattggatttcatcatttaaaaaccatacttgtatatgtagttataatatgtaaggaatacattgtttataaccagtatgtacttcaaaaatgtgtattgtcaaacatacctaactttcttgcaataaatgcaaaagaaactggaacttgacaattataaatagtaatagtgaagaaaaaatagaaaggttgcaattatataggccatgggtggctcaaaactttgaacatttgagcttaaacaaatgccactctcatgcattctaaattaaaaagttaaaatgattaatagttcaggtggaagaaataagcatactttttgggttttctacacattttgtgtagacaattttaatgtcagtgctgctgtgaactaaagtatgtcatttatgctcaaagtttaattcttcttcttgggatattttaaaaatgctactgagattctgctgtaaatatgactagagaatatattgggtttgctttatttcataggcttaattctttgtaaatctgaatgaccataatagaaatacatttcttgtggcaagtaattcacagttgtaaagtaaataggaaaaattattttatttttattgatgtacattgatagatgccataaatcagtagcaaaaggcacttctaaaggtaagtggtttaagttgcctcaagagagggacaatgtagctttattttacaagaaggcatagttagatttctatgaaatatttattctgtacagttttatatagttttggttcacaaaagtaattattcttgggtgcctttcaagaaaattaaaaatactactcactacaataaaactaaaatgaaaa

SEQ ID NO: 98 - DNA, 527 bp, Homo sapiens
atcacttctgagcacggagcaatggcctctcgctgggctgtgcagctgctgctcgtggcagcctggagcatgggctgtggtgaggccctcaagtgctacacctgcaaggagcccatgaccagtgcttcctgcaggaccattacccgctgcaagccagaggacacagcctgcatgaccacgctggtgacggtggaggcagagtaccccttcaaccagagccccgtggtgacccgctcctgctccagctcctgtgtggccaccgaccccgacagcatcggggccgcccacctgatcttctgctgcttccgagacctctgcaactcggaactctgaacccagggcggcagggcggaaggtgctcctcaggcacctcctctctgacggggcctggctccacctgtgatcacctccccctgcttcctgctgctgtggcacagctcactcatggggtctgaggggagagaagcacaccaggggcgccctctgccttccataccccacgcttataaaacataactaagccaaga

SEQ ID NO: 99 - DNA, 6464 bp, Homo sapiens
gaaacacagactgggagcgggcgggagcgggagcgcggcgcacgccccgggccggcccagccagcgagcgagcgagcggcgagccgggaggaggagggtggcggggcggtgaggccgcagaggcggagggatctgcgcatcaaagctagcgaggcgagcgaagtttggccgggggttggactttccttcccggaggcggcacccaaacagctaccccgtgcggaaacccaaacttctgctgccacttggagtctcgcggccgccgcctccgccccgcgttcggggccttcccgaccctgcactgctgccgtccgcccgcccggccgctcttctcttcgccgtgggagccgctccgggcgcagggccgcgcgccgagccccgcaggctgcagcgccgcggcccggcccggcgccccggcaacttcgccgagagttgaggcgaagtttgggcgaccgcggcaggccccggccgagctcccctctgcgcccccggcgtcccgtcgagcccagccccgccgggggcgctcctcgccgcccgcgcgccctccccagccatgtcgtccatcctgcctttcactcccccgatcgtgaagcgcctgctgggctggaagaagggcgagcagaacgggcaggaggagaaatggtgcgagaaggcggtcaagagcctggtcaagaaactcaagaagacggggcagctggacgagctggagaaggccatcaccacgcagaacgtcaacaccaagtgcatcaccatccccaggtccctggatggccggttgcaggtgtcccatcggaaggggctccctcatgtcatctactgccgcctgtggcgatggccagacctgcacagccaccacgagctacgggccatggagctgtgtgagttcgccttcaatatgaagaaggacgaggtctgcgtgaatccctaccactaccagagagtagagacaccagttctacctcctgtgttggtgccacgccacacagagatcccggccgagttccccccactggacgactacagccattccatccccgaaaacactaacttccccgcaggcatcgagccccagagcaatattccagagaccccaccccctggctacctgagtgaagatggagaaaccagtgaccaccagatgaaccacagcatggacgcaggttctccaaacctatccccgaatccgatgtccccagcacataataacttggacctgcagccagttacctactgcgagccggccttctggtgctccatctcctactacgagctgaaccagcgcgtcggggagacattccacgcctcgcagccatccatgactgtggatggcttcaccgacccctccaattcggagcgcttctgcctagggctgctctccaatgtcaacaggaatgcagcagtggagctgacacggagacacatcggaagaggcgtgcggctctactacatcggaggggaggtcttcgcagagtgcctcagtgacagcgctatttttgtccagtctcccaactgtaaccagcgctatggctggcacccggccaccgtctgcaagatcccaccaggatgcaacctgaagatcttcaacaaccaggagttcgctgccctcctggcccagtcggtcaaccagggctttgaggctgtctaccagttgacccgaatgtgcaccatccgcatgagcttcgtcaaaggctggggagcggagtacaggagacagactgtgaccagtaccccctgctggattgagctgcacctgaatgggcctttgcagtggcttgacaaggtcctcacccagatgggctccccaagcatccgctgttccagtgtgtcttagagacatcaagtatggtaggggagggcaggcttggggaaaatggccatgcaggaggtggagaaaattggaactctactcaacccattgttgtcaaggaagaagaaatctttctccctcaactgaaggggtgcacccacctgttttctgaaacacacgagcaaacccagaggtggatgttatgaacagctgtgtctgccaaacacatttaccctttggccccactttgaagggcaagaaatggcgtctgctctggtggcttaagtgagcagaacaggtagtattacaccaccggccccctccccccagactctttttttgagtgacagctttctgggatgtcacagtccaaccagaaacacccctctgtctaggactgcagtgtggagttcaccttggaagggcgttctaggtaggaagagcccgcagggccatgcagacctcatgcccagctctctgacgcttgtgacagtgcctcttccagtgaacattcccagcccagccccgccccgccccgccccaccactccagcagaccttgccccttgtgagctggatagacttgggatggggagggagggagttttgtctgtctccctcccctctcagaacatactgattgggaggtgcgtgttcagcagaacctgcacacaggacagcgggaaaaatcgatgagcgccacctctttaaaaactcacttacgtttgtcctttttcactttgaaaagttggaaggatctgctgaggcccagtgcatatgcaatgtatagtgtctattatcacattaatctcaaagagattcgaatgacggtaagtgttctcatgaagcaggaggcccttgtcgtgggatggcatttggtctcaggcagcaccacactgggtgcgtctccagtcatctgtaagagcttgctccagattctgatgcatacggctatattggtttatgtagtcagttgcattcattaaatcaactttatcatatgctcttttaaatgtttggtttatatattttctttaaaaatcctgggctggcacattgactgggaaacctgagtgagacccagcaactgcttctctcccttctctctcctgaggtgaagcttttccaggttttgttgaagagatacctgccagcacttctgcaagctgaaatttacagaagcaaattcaccagaagggaaacatctcaggccaacataggcaaatgaaaagggctattaaaatatttttacacctttgaaaattgcaggcttggtacaaagaggtctgtcatcttccccctgggatataagatgatctagctcccggtagaggatcaccggtgacaactatagcagttgtattgtgtaacaagtactgctcccagcagcaattagggagaaaactagtctaaattatttcaactggaaaaaagaaaaaagagtcctcttcttttcccagccttttgcagaacacagtagacagaactgccaccttcaattggtactttattctttgctgctgtttttgtataaaatgacctatcccacgtttttgcatgaatttatagcaggaaaaatcaagggatttcctatggaagtcctgctttattccaggtgaagggaaggaagtgtatatacttttggcaagtcatacagctcaaatgtgatgagatttctgatgttagagggagatggagaggcttcctgatgcctcatctgcagggtcctgtgcctctgaagttctagccatgaggtttccaggtaggacagctgctccccaagcctcctgaggacacaggaagagacggaaggagcaccttgacagacttgtgtgagtcttctcgaaggagggttgactcagaacccagagacaatacaaaacccctcacttcctctgagagggccaaatgctgtgagtctgaagtatgtgcctggtgtgaaatgatctatggcctgtttcttacacaggaagccccctgaacctcctgtacatgtgttcatgttcccagccagctctgagacccaggaaccaaatattccattttggcttctgctagagcagtcatggttcctctcctaaaagccatgggcagcagtttccgagggcctgcatgatccacctgctgcacgatcctatgagggcttcctgtggcacacagccctctgggtgcttgggaactagcttcaggcacagcctgattctggtgatccagtgatctatggaagtcgtgtcttactccaggtgaagggggaaaaaaaaagcctatactttggcaggttatgaactttgaatgtgatgaaatgacacgtttggctgcatttggatggtgtcttagaaccctcattgctcagacctgaaggctacttctaggagcatgaagtttgagttttgtgtttttccaaaggatacttccttggccctttttctttattgactagaccaccagaggaggatgtgtgggattgtaggcaaacccacctgtggcatcactgaaaataaatttgatcatacctaagaggttaggaaatggtgccattcccaccttagagtgctacataggtgctttgggcgtatgtaacattagtgtccttccttgaagccacaagctagttttcttagttttaaaatcctgttgtatgaatggcatttgtatattaaaacacttttttaaaggacagttgaaaagggcaagaggaaaccagggcagttctagaggagtgctggtgactggatagcagttttaagtggcgttcacctagtcaacacgaccgcgtgtgttgcccctgccctgggctccccgccatgacatcttcaccttgcagcttgtgctgagactgacccaagtgcagctagcactgggacacagatccttgtcttcagcaccttccaaggagccaacttttattccctttcctctctcccctccccacctcgcttcttcccaatttagtaacttagatgcttccagcacatacgtaggtagctaccccagccggtttggattacaggcctgtgctggaacatcatctcagttggccaccttcctggcaggctgtagacctgacattttgagacaagcctagaggagtcaggagcagggactttgactcttaggaagagcacacatgagggcaaggctgctggcagacgtctccattgtccttatgttgtctgtgttgtatttttttttttttattgaccatggtgattatttttttaaaccatcgttaatatactgaagtgagctatagcacatatcatgtgcttagtttgtttatttttctccatctccccttggcttcctagagtttggacatattccaggctaaatgcttttactcaagactacagaaaggtttgaagtagtgtgtgcatggcatgcacgtatgtaagtaatctggggaagaagcaaagatctgtttcattcttagcctcaggcctcatgagggtctccacagggccggagctcaggttacaccactccttcgtccttacaggagatgtagggagaagaatctgcaggctgcttgtaggactgttcaccaagggggataccagcagcaagagagtgcacccgtttagccctggaccctgtttcttactgtgtgacttggctagagttgggagttcccccaaaataaacgtgtccccattttaccagaaccaaacctcaacacagcgaagctgtactgtctttgtgtggcaaagatgttcccttgtaggcccctttcaggtaaccgtcttcacaatgtattttcatcacagtttaaggagcatcagccgcttctcaagtgggtagggaaagcagaaaaacgtacgcaagaggacatggatccaaaatgatgatgaagcatctcccatggggaggtgatggtggggagatgatgggctaaacaggcaacttttcaaaaacacagctatcatagaaaagaaacttgcctcatgtaaactggattgagaaattctcagtgattctgcaatggatttttttttaatgcagaagtaatgtatactctagtattctggtgtttttatatttatgtaataatttcttaaaaccattcagacagataactatttaattttttttaagaaagttggaaaggtctctcctcccaaggacagtggctggaagagttggggcacagccagttctgaatgttggtggagggtgtagtggctttttggctcagcatccagaaacaccaaaccaggctggctaaacaagtggccgcgtgtaaaaacagacagctctgagtcaaatctgggcccttccacaagggtcctctgaaccaagccccactcccttgctaggggtgaaagcattacagagagatggagccatctatccaagaagccttcactcaccttcactgctgctgttgcaactcggctgttctggactctgatgtgtgtggagggatggggaatagaacattgactgtgttgattaccttcactattcggccagcctgaccttttaataactttgtaaaaagcatgtatgtatttatagtgttttagatttttctaacttttatatcttaaaagcagagcacctgtttaagcattgtacccctattgttaaagatttgtgtcctctcattccctctcttcctcttgtaagtgcccttctaataaacttttcatggaaaa

SEQ ID NO: 100 - DNA, 8214 bp, Homo sapiens
gttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccgagggggaggacattttcaccggcgccgcggtggtcagtaaacatcagtctccaaagataactacatcccttcttcccatcaacaatggctccaaagaaaatgggatccatgaagaacaagaccaagagccacaggatctctttgcagatgccacagtggagctatccttggacagcacacaaaataatcagaagaaggtgctagccaaaacactcatttctcttcctcctcaggaagccacaaattcttcgaagccccagccaacctatgaggagctagaggaagaagaacaggaggatcaatttgatttgacagtcggtataactgatcctgagaagataggggatggtatgaatgcatatgtagcctacaaagttacaacacagacaagcttaccattgttcagaagcaaacagtttgcagtaaaaagaagatttagtgactttctgggtctttatgagaagctttccgagaagcactctcagaatggcttcattgtccctccgcccccggagaagagcctcatagggatgacaaaagtgaaagttgggaaggaagattcttcttctgcagaatttcttgaaaaacggagggccgctttagaaaggtaccttcagaggattgtaaatcatcctaccatgttacaggaccctgacgtcagagagttcttggaaaaagaagagctgccacgtgccgtgggtacccagacattgagtggtgctggtctcctcaagatgttcaacaaagccacagatgccgtcagcaaaatgaccatcaagatgaatgaatcagacatttggtttgaggagaagctccaggaggtagagtgtgaggagcagcgcttacggaaactgcatgctgttgtagaaactctagtcaaccataggaaagagctagcgctgaacacagcccagtttgcaaagagtctagccatgcttgggagctctgaggacaacacggcattgtcacgggcactctcccagctggctgaggtggaagaaaaaattgagcagctccaccaggaacaggccaacaatgacttcttcctccttgctgagctcctgagtgactacattcgcctcctggccatagtccgcgctgccttcgaccagcgcatgaagacatggcagcgctggcaggatgcccaagccacactgcagaagaagcgggaggccgaggctcggctgctgtgggccaacaagcctgataagctgcagcaggccaaggacgagatcctcgagtgggagtctcgggtgactcaatatgaaagggacttcgagaggatttcaacagtggtccgaaaagaagtgatacggtttgagaaagagaaatccaaggacttcaagaaccacgtgatcaagtaccttgagacactcctttactcacagcagcagctggcaaagtactgggaagccttccttcctgaggcaaaggccatctcctaatggaccaaggaccccagagcccacctgtgtgacgctgcctttttatacactgtcctcctccaccttgatggacccctagtgatgcatcctgcctaggctggacttaaccccttcctccctgtccccacgaccaactgtccccagttactctaaccgttatttcatttagcttccatatatattttcttacctaagagaatagtttcctgctttaagcaaaagacctacaataggtggtggaattatgggatggggtggagtattgatataaatatataaatacaaatgtatatttttcaggatgtggtttaggaactgggaataacgttttctgttactcctgatggtgccatgaaaaggttatgtaataaaatattttaaaatcaggtcacatgactcagaatgttggtggtttttgcttaggctggggagcagttgggaatcaggtctggaatactcctaaccaagaagttgcccaggtatagtaagtttttctctaccgttcacaagttttgtgctgctgcttccctctggaaatggggtttctttctctccgcctacctcagctacctgttctgagggtctcaatctgtttcgtattcccacttctttagggaaggagttttaaaaacatctcttaaaataagaggagcaaaatctattaaaacctattctcctgcaaaggaggcagagactttctctctctcttttttttttttttttggtgtccctatcattaagcaagagcctttctcttttattcttcctgcttccctaagctgctcagggttctctgagtcttgccctctgatggcaagtcttatatataactaaacctatttttgtcacccatcaaaacacatcctcagtagactgtgtgaaggtgtgaaggtctgataatgacttgatgctttgtctccatagacatgaaagccatgccctctgcctctagatagggtgatccaagagctcctgaaccttaggaggttcaaagaagctctactgtctgtgcccaggaggtagcctgccagcaagagccctcaggagttgcacacacagccaaagggtgttcacacagatctctgccggtctagccaggggaggccagagtctcgtcagtcaaggatgggcttcccccttagctgtgtccacagctgctcaagctatactggtcagagtgggctttgaagctcctttgtgagctcgagctgctgactgccactatgggagccttgccacctccagcccctccatcccaaagacgctcctgccactggggccccaggtcctgctgtatcagttctctttggtggggggctaaggtttggggcgaggcaacctgagacaagaaaacgcagtaaacattctgattccctgtacacagatgcagcaccaggggaagggccagtggtgcaagtatttctttttaacaggtgaagtttttggaaaaagtcactctccctacccctcagtatccttaccatcaactttggttttatccttccagtctttattatatgcttgcttttacatagttgtaataatatacacataaagtattttgtatcctgcttttatcattcaacattgtacatgttataagcattttactatattgttatatatcttcacaaagttgatctgtaaagctgtgtaatttgaaggcatccatagggtgactgtaccataattttgattcatcccttgttgttggattcttggtcaggggttgtttgttttgttttattggtaactttaaaattttgaatacaatttcagatttacagaaaagttgcaggaatatcacaaagaactcctatatatcttttatccagatttactgagtgtttacattttatcccatttgccttatctatatttcatgttgcattttcttaatcatttgagaataatttgcacagataccccattatgcccaaaacagtatgcatttccctaagaacaggacattctcttctaagagaagaagagaattactttaagcattattcagtatttttttaagtattattatcaaaatcaggaagtttaacagtgatttaatactgttatctaacccatgattcatatttaaattttgccatttatcccaataatgtcctttgtagccattcttttaccttgtgcaggatcatgttacatttgtaaacgtgtgtctctcaatactgcagattcctcaactttcttttgtctttcattaccatgacatttttgaagaatacaggctattttgtcgaatgttcctcagtttggatttgtgtgatggttccgcatgactaggtgagggttttgcattctgggtgggaatatcacagaagcagtgtgtcgtcagtgcgtcgtaatcagcatataatgtcagttggtcccattaatgttgttaactctgttcaccgcttaggttggtgtctgccagatttcattttaaatttacgatttcctctttgtaatttacaagtaatttgtggggagatactttgagactatataagtattttgttcctcattcaccagttatatagtatcagttgattagtcttgtcccagttattactgtcatgattgaccaacatgatttcctaactccataatgccttctacatttattggttgacattctacatacaaagaaaaacatcctttctcaccatttatttattcacttgtttatcaatatggatgcagggattcctgttttactcagagttgcaagccattgctttgattttatcttgattctcaaattgtcccagatttatagcggcctcttgtgtgtttgtagcttgctcccatcatgttttgagtactttcttaccttctggcataacaagatgttccaggctcatcttgaatgttccctaccctagccctggaatcagccatttctccagggagtcttggttccttataatggagaatggtatttatttatttttatttgatttgattattattactatttttgagacagagtctcgctcttgtcgcccaggctggattgcaatggcacaatctcagctcactgcaacctccacctaccaggttcaagcaattctcctgcctcagccttccaagtagctgggattacaggtgcctgcccccacacccagctaatttttgcatttttggtagaaatgggggttttaccatgttggggaggctggtctcgaactcctgacctcaggtgatctgcccacctcaacctcccaaagtgctgggattacaggtgtgagccaccatacccagccagagaatgttatttagaaaccaagatctgggtgccaaatgtgctgcttgttactggaatgtcattgcctctaggctctcaccatacagtgcaaagagatgatagatagatagatagatagatagatagatagatagatagatgatagatatagatagatagatagattgattgatttgtagaaacaagataggttagagatacctgacataaatagatactaaaaatcatgaattcacactgatgctttgagaccagccctgtaggtttattccagtctgcccccttttccatgttgttaactctttcctccagagagacaaagatttcaggttgctttgttaagttccatctaatgatcattctgacgtaagtctgtttttcttatttccttggaatgatgtctcctctggtttcagaacttcctcctctgcttcctgtatcctgaggctggcggggccagttgtctttagggcttgtgcatttttgtaaagagcttgcacgtgtggaaatcaagtaggccagtagtgggttaggggtactgagccagaagcctctacaaggaataacaggagcacaaaggaagaaggtggtattccagctggggacccaggagggaggactttgtggagaacctgatgcttgaactgagtctaaaaggtgtaaaagtgtttgttgcttctgcctccctgtctgtctggcagggtgaggtaggcgcatctagggaaatgtcaagtggcttggtgtagggtaaagtcagtgaggcccatggagaaaaacgagcaggagccacatcacatgggtgtctgataggacctgggaggcgctttccacattaccattgtcgcttcgtgatctggacacaccagaaggcgtgagactggaggcaggaagagcagccaggcttatccctaccctcaggagagctgaaaagggcaggtatggtggggccagagctcaggagagtttcggaaccactgagatcggtccttgatttgatgagaggcttgaggggagagggaggtagctaggatgccccgcaagcttctggcccagacactgggcagacaatgaaaccctttgtaacacatgaggcaataggtttggggcagatgggaggggaagcagtggtgggggcagtgagtgctgaaggtgttttaagaagcggctctgggccaggcacagtggcttatgcctgtattcctagcattttgggaggccgaggtgggagaatcacttgagcccaagaatttgagaccagcctggggaatatagtgagaccctgtccctacaaaaataaaaacaactagctgggtgtgtggtggtgcatgcctgtaggcccagctacgcgggaacatcacctgagcccaggaggttgaggttgcagtgagctacagttgcgccactgcactccagcctaggtgacagagcaagatcttgtctcaaaaaaaaaagcagctctggatgggaagggaggccagttgctttaagtaggggagatagagttaaaggaggctttgttttatttaaaggtgggacaaacttaagcatgttaataaaattcagagaagagaaagagaatgactatcagagccatgtttggaagaaaatggggtccagagcacaggaaggggacctgtgttcagagggtgcctcactgctgaggccacaggaaagaatctgtaggtggaggggaggccgaagaggggaagtttcatgcttgataattaaaattttctgagataggaatgtcatatttacctatttaagccaagtttttttagataaaaggtatggaacctgctttccccttggctagttcagcgtttgggctccggagtgctgaagatgaggactggacttcgagctggtgtgatcccagtattcagtgtcagtactcagtgacaaaataaatgagagaaacgggaataagaattgtcgcctacacaaaaataccagcaactgttaactcttcccagaagattttcattctgaatgctcctgtagctaggaaccctaaaaagtctttgaagcaactcaagttttaaaaaaggggaggaactcctggaaatctcaggatggggccaagatgtggctggagagtgtgtggtgatggagggcgtgtcttttgccgagcacactcagggcccacgggaagcccatagacttcaaggacatcaagccccaaggtggtgggattttccccaccagtacttggcagcctagggggaaggggagggcgggagaagataatggggatccctggctccaaacataggaggacacatctgtgctacagtgcgcacatgcctggatgtacactctgtctttggagacactggctaagattctctgctccatgtttggacagggtcgtgcctgatctgagataaatggacaagaacaactgaagcctgtcttctggtgcatgtgtcacctgccgataactgcatcttgtgataaagttgggtgatttacagtctccaccaaatgctaaactctggggtcttacgcctttataactccatgggccccagcaaaggttcaggctcaaaacaggtgtcaaatagataactgttgaatgattgttccccagttgcaggctctgccacctggcgttcatactgtctgtgaaaggacccagctcacctttccctctttatctcccagtccttcccaacagcgccgacacctcatggaaactgattgcaaatgtgctacttctcacttctgtgtggcccgaggaggctgggttaatgctgggcttggtaccttaagcaccctttctcccttccccatcttcattctcagaattacacctgtctgaagcaggcattttccaatgccctagatgggaatataagtgtaaggagatgtgaagcatttgcctgtgtgtcagaacattcactgaggatcctcataggcacttctagaaaccaaatccttgaagatgactaaccagaaatgcccgtcatagcactgtttacagttgcaaaaactgaagccaattgaaatgtccatcaggaggggattaaatgaattatggtacagttacaccgttgaatattttacagccattgaagatgatatatagctatattcattgacaaggaaaactcatattttttagtgaaaaaagcaggttatagaattgcatgatattcacatttatataaaactttatatatgggaaggatgttgattgaattgttaataactatggtcacctctagagatggaagtttgcattacctttaatttttaataccattttgtattgcttaaaatttgtatgtattatcgttaaaataagaaaaatcaaataaagctattttcattatgggaaaa

SEQ ID NO: 101 - DNA, 1320 bp, Homo sapiens
gccacaaacgctgagcccaggtgggagaggtctggcctatccgcgcctggcagctgtcggaactccggagaccacaaaggggtttatggtttaccccctccacggaaggtcggtctgatcgcagctgcgggtcggggagagggaccgggggtcccccagtcagtaggcctcagaacacctcttcagtgccggggcaccagacagcggattttgcattcgactctccccaaagtgtgccgaacaggttggaagcaaaggctccggtttaagctctgggcttggggataaaatacactttttaaggacccaagttcctcggcaacgactccagactgggaagacctttccattttcaggatcgacgcttcacgttgaggggagggcattcaggacgccctcttaaggcttctcccaacccatggcgctaccaggctcctcacaggaccaggcctggagcctggagcctccggctgccacggctgctgcctcctcatcttcgggaccccaggagcgggagggcgctgggagccccgcggcccccgggacgctgcccctggagaaggtgaagcggccgatgaacgcgttcatggtgtggagctccgctcagcgccgccagatggcgcagcagaaccccaagatgcacaactccgagatctccaagcgcctgggcgcgcagtggaagctgctggacgaggacgagaagcggcccttcgtggaggaggccaagcggctccgcgcccgacacctgcgcgactaccccgactacaagtaccggcctcggcgcaaggccaagagctcgggcgccggaccttcccgctgcggacagggaagaggcaacctggccagcggcggcccgctctgggggccggggtacgcgaccacccaaccgagcagaggctttgggtacagaccccccagctactcgacagcctacctgcctggcagctatggctcttcccactgcaaactggaagccccctcaccgtgctccctccctcagagtgaccctaggctccagggggaactgctgcccacctatacccactacctgccccctggctctcccactccatacaaccctccccttgctggtgcccccatgcccctaacccacctctaaccctcatggacgcagacctcacgggacgggcctcatcctccttttttaatccagcagcatcccctaccccaggctgtcaaccctttctcctgttggactacagttcagaggcagcctgcagtcctcccatgatagccagggagagccgcacaacatacaattatatttttggtagtattaaacagttttgtattattcaa

SEQ ID NO: 102 - DNA, 2634 bp, Homo sapiens
gtcctcagcggccgggcccacggccccgagcagccatgctgggcgcgcgggcctggttgggccgcgtccttctgctgccccgcgccggtgcaggcctcgccgcgagccgcaggtgtcctggagtctggcccaggacctggccccacaggagtcccagcaggggtagctcctcccgggacaaggaccgaagtgcgacggtcagtagttcagtgcccatgcctgctggagggaaaggaagccatccttcatctacaccccagagggtccccaaccgcctgatccacgagaagtcaccatacctcctacaacatgcctacaatcctgtggactggtacccctggggacaggaagccttcgacaaggccaggaaggaaaacaagccgattttcctctcagtcgggtactccacctgccactggtgccacatgatggaagaggagtccttccagaatgaggagattggccgcctgctcagtgaggactttgtgagtgtgaaggtagaccgtgaggagcggcctgacgtggacaaggtgtacatgacgttcgtgcaggccaccagcagcggcgggggctggcccatgaatgtgtggctgactcccaacctccagccctttgtcgggggcacctatttccctcctgaggatggcttgacccgagtcggcttccgcacagtgttgctgagaatacgagaacagtggaaacagaacaagaacaccctgctagaaaatagccagcgtgtcaccactgccctgctggcccgatcagagatcagcgtgggtgaccgccagctgccgccctctgccgccaccgtgaacaatcgctgcttccagcagctggatgagggctatgatgaggaatacggtggcttcgctgaggcccccaagtttcccacgccggtgatcctgagcttcctgttctcctactggctcagccatcgactgactcaggatggctctcgggcccagcagatggccttgcataccctgaaaatgatggctaacgggggcatccgggaccatgtggggcagggctttcaccgctactccacagaccgccagtggcacgtccctcactttgagaagatgctctatgaccaggcacagctcgctgtggcctattcgcaggccttccagctctctggtgatgaattctactctgacgtggccaaaggcatcctgcagtacgtggctcggagcctgagccaccggtccggaggcttctatagcgcagaagatgcagactcgcccccagagcggggccagcggcccaaagagggcgcctactatgtgtggacggtcaaagaggttcagcagctcctcccggagcctgtgttgggtgccaccgagccgctgacctcaggccagctcctcatgaagcactacggcctcacagaggctggtaacatcagccccagtcaggaccccaagggggagctgcagggccagaatgtgctgaccgtccggtactcgctggagctgactgctgcccgctttggcttggatgtggaggccgtgcggaccttgctcaattcagggctggagaagctcttccaggcccggaagcatcggcccaagccgcacctggacagcaagatgctggctgcctggaatggcttgatggtgtcaggctatgctgtgactggggctgtcctgggccaagacaggctgatcaactatgccaccaatggtgccaagttcctgaagcggcacatgtttgatgtggccagtggccgcctgatgcggacctgctacaccggccctggggggactgtggagcacagcaacccaccctgctggggcttcctggaggactacgccttcgtggtgcggggcctgctggacctgtatgaggcctcacaggagagtgcgtggctcgagtgggctctgcggctgcaggacacacaggacaagctcttttgggactcccagggtggcggctacttctgcagtgaggctgagctgggggctggcctgcccctgcgtctgaaggacgaccaggatggagcagagcccagcgccaattccgtgtcagcccacaacctgctccggctgcatggcttcacgggccacaaggactggatggacaagtgtgtgtgcctattgaccgccttttccgagcgcatgcgtcgtgtcccggtggcgttgcccgagatggtccgcgccctctcagcccagcagcagaccctcaagcagatcgtgatctgtggagaccgtcaggccaaggacaccaaggccctggtgcagtgcgtccactctgtctacattcctaacaaggtgctgattctggctgatggggacccctcgagcttcctgtcccgccagctgcctttcctgagtaccctccgacggttggaagaccaggccactgcatatgtgtgtgagaatcaagcctgctcagtgcccatcactgatccctgcgaattacgaaaactactacatccatgactgccccaacccccttggggtggggcagaaggtgaagcatcccaactgactagagactcaggccctgcagggccctatagaacctgtggccatccctgagcaccctgccaccaggtgacctcggccatactcactgccccccttgggcacccactcaccctagaataaacttaacagtgtcccgtggtaa

SEQ ID NO: 103 - DNA, 3962 bp, Homo sapiens
agcaagggcctccctcccccgcatcacgtgatctcagctccttttcagctagtgggtggaaccccaggagggaaaactcagggaagcccagggcccgtgttgtgcttttggcccaggtaggtggacagacatgtcccaggcgggggacgtagaaggccccagcacaggagaccctgtgctcagtccccaacacaactgtgagcttttacagaacatggaaggagccagctccatgccaggcctgtcaccagatgggccgggagcaagctctgggcccggagtcagggctggcagcagaaggaagatccccaggaaggaggcccttcgaggtggcagctcccgggctgcaggtgctgctgaggtccggccaggggtcttggagctgctagctgtggtacagagccggggctcgatgctggctcctgggctccacatgcagctgccctcggtgcctactcaggggagagctctgacctccaagaggctccaggtttctctgtgtgacatcttagatgacagttgccccaggaaactttgtagcaggtctgctggcctcccagagagagctctggcctgcagggagaggcttgcaggagtggaggaggtgagctgcctcaggcccagggaggccagagacggtggaatgagttctccagggtgtgacagaagaagccccacactcagcaaagaggagccccctggaaggcccctgacatcctcaccagacccagtccctgtgagggtaagaaagaaatggaggaggcaaggggctcattcagagtgtgaggaaggggctggtgacttcctgtggcttgatcagagccctcgtggggacaacctcctgtctgtgggagaccctccccaagttgctgacctggagtccttgggaggcccttgcagacctccctctccaaaagacactgggtctgggcctggagagccaggtggaagtggggcaggatgtgcctcagggactgagaaatttggatatttgcccgctacaggggatgggccccagccaggcagcccctgtggccctgtcgggttcccagtgcccagtggaggggagtccctcagttcagctgcacaggctcctccacagagcgcagcactgtgcctgggggcgtcagcacaggcctctgcagagcagcaagaagctgtgtgtgtcgtgcggactggcagcgatgaaggccaggctccagcacaggaccaggaggagctggaggccaaggctcagccagcttccaggggaaggctggagcaaggactcgctgcccccgctgacacctgtgccagctcccgggagcccttgggcggcctcagctcctccctggatactgaagccagcagggcctgctcaggcccattcatggagcagagaagatccaagggcactaagaacctgaagaaaggtccagtgccctgtgcccaagaccggggcacagacagaagctcagacaactcccaccaggacaggccagaggaacccagcccaggaggctgccccagactggaggaagtgaaaataccccatggagtgaagcttgtgtgctacctgggttccgggccagtgatccagctcctgggggccatcagccacggccaggcaggggggcagctgccaccaaagctggaggttctagaggacttgatggaggtcagctcaccctcacctgcccagaggctcagaaggaagaaaaggcccatggtgcagggccctgctgggtgccaggttttccagccttctccttcaggaggcacagcaggggaccctggtggcctctctgaccccttctaccctccaagaagcggttccctggcccttggcgaccccagctcggaccctgcatgttcccagagtggcccaatggaggctgaagaggattctcttccggagcagccagaggactcagctcagctccaacaggagaagccatccctgtatattggggtgcggggcactgttgtccgttccatgcaggaggtactatggactcgccttcgggagctcccagacccagtgctgagtgaggaggtggtggagggcattgctgctggcattgaggcagccctctgggacctgacacaaggcaccaatggccggtacaagaccaagtatcgcagcctgctgttcaacctgcgggaccccaggaacctggacttgtttctcaaagtggttcatggagatgtcaccccctacgacctggtgcggatgagctcgatgcagctggccccccaggagctggcccgctggcgggaccaggaggagaaaaggggcctgaatatcattgagcagcaacagaaggagccgtgcagacttccagcctccaaaatgacccacaagggcgaagtggagattcagcgggacatggaccagacactgaccctggaggatctggtgggaccgcagatgttcatggactgcagcccacaggccctgcccatcgcatcagaggacaccacggggcagcatgaccaccacttcttagaccccaactgccacatctgcaaggactgggagccctcgaatgagctgctaggctccttcgaagccgccaagagctgcggggacaatatcttccagaaagccctaagccaaactcctatgcctgctccagagatgcccaaaaccagggagttgtctcccacggaaccacaggacagggtccctccatctgggctccatgtgcctgctgcacccacaaaggccctgccctgcctgccaccctgggaaggtgttctggacatgttctccatcaagcggttccgggccagggcccagctggtctcgggacacagctgtcggcttgtccaggctctgcccaccgtgatccgctcggcaggctgcatcccctccaacattgtctgggaccttctggccagcatctgcccagccaaggccaaggacgtctgcgtggtcagactgtgcccacatggggcccgggacacccagaactgccgcctgctctactcatacctcaatgataggcagcgccacgggctggcctctgtggagcacatggggatggtcctgctgcccctgcctgccttccagcccctgcccaccaggctgcgccctttggggggcccaggcctttgggctcttcctgtctcccctctcctttccccaggtctggaggtcactcactcaagtctgttgctggctgtgctgctccccaaggaagggcttccagacacagcagggtccagcccctggttggggaaggttcaaaagatggtctccttcaacagtaaggtggagaagagatactatcagccagatgacaggaggccgaatgtgcccctgaagggcacccctcccccaggaggtgcctggcagcagagccagggcaggggcagtatagctccaaggggaatctctgcttggcagaggccccccagaggcagggggaggctctggccagagcctgaaaactggcagcatcctgggcgagggcagtggcccccagagccaggcttgcgccagtcccagcatccctattcagtagcaccagctggtcatggctttggccgtggccagcacttccacagggactcctgtccccaccaagccctgctccggcacctcgaatccctggcgaccatgagtcaccagctccaagccttactgtgcccccagaccaagagctccatcccccgccctctgcagcgtttgtctagcgcccttgcagctccagagccccctggcccagcccgtgactcctctttggggcctacagatgaagctggctctgagtgtcccttccctagaaaggcctgaccctccttacccaccagaacaggggttttgatgccctcactagtgttgaagcctgttccagagagaggtgggactgcaaggagaggatggtcagccctacccacctgccctgtttgaacttcctgtttgacaatgtttgctgttgattttttgttcaataaagaatttggtaaaattggga

SEQ ID NO: 104 - DNA, 7270 bp, Homo sapiens
gctgcgctccaccccagtggctggaggagcagctctccagtcagcctttgcagcccctctctttttccctttccaccgggcctcctcggatcccttggctgggcactgaggcgggggaagaggctggggtcgccacggcggaggttgctgccgccacccccctgcgggggtggccggggttcccggctgggggggtaccgttctgggtgaggcatccaccatggtgaggcccctgtgccgctgcccccgcgcccccccggccgccgctgcctcctgcccctcggtgctgctgttgctcccccgcctgctgttgctcctccatctccagatcggatcacggtgagggaaagatgagcgaggagacggcgacttctgacaacgataatagttatgcacgagtgcgagctgtggtgatgacccgagatgactcaagtggtggatggttaccacttggagggagtggactaagcagcgtcactgtcttcaaagtccctcatcaggaagagaatggctgtgctgacttttttatccgtggagagcgactcagggacaaaatggtggttttggaatgtatgcttaaaaaagacctcatttataataaggtcactccaacatttcaccactggaagattgatgacaagaagtttggtcttacgtttcaaagtcctgctgatgctagggcttttgatagaggtatccgaagagctatagaggatatttctcaaggatgccccgaatcaaaaaatgaagctgaaggggcagatgacttacaagcaaatgaagaggattcttccagttctctagtgaaggatcacctttttcagcaagagacagttgttaccagtgagccttatagaagctcaaatataagaccttctccctttgaagatctgaatgccagaagagtctacatgcaaagccaagccaatcagataacatttggtcagccaggcttggacattcagagcagaagtatggaatacgtacagcggcaaatatccaaggaatgtggaagcctaaagtcccaaaatagggtccctttgaaatcaatcagacatgtcagctttcaagatgaggatgagattgtcagaataaaccctcgagatatcttaatacgtcgctatgcagactacagacatcctgacatgtggaaaaatgacttggaaagagatgatgctgattccagtattcagttttctaaaccagacagtaaaaaatcagactatctgtactcttgtggggatgagactaagttaagttcacccaaagactctgtggtatttaagacgcagccttcctcattaaaaattaagaagtcaaaacgaagaaaagaggatggtgaacgttctcgctgcgtatactgccaggaaaggtttaatcatgaagaaaatgttaggggaaaatgtcaggatgctccagaccctattaaaagatgcatatatcaagttagttgcatgctctgtgcagagagcatgttgtatcattgtatgtcagactcagagggagatttttctgatccctgttcgtgtgacactagcgacgacaagttctgcttgcgatggttagccctggtagctttgtctttcattgtaccatgtatgtgctgctacgtccctttgagaatgtgccatcgctgtggtgaggcatgtggttgctgtggtgggaaacataaagctgctggatgaaatggtccagtgccaaaatgagcttaaaatctttgtttccaggaattagctaacttggatttgtggaagcttttggcaagcaatatggaatcttgcctggtatcattgagcccacacatggaggaagcagaactcatcagttcttggcgtttcacgccatgcctaacttttcccttgagtgcatggcatgttttgttacaggttgtagagtatttgcagaaggaaaccatttctggttatttggctataaaaagtcagcataaaatatgatccaactaaaagggattaatttttggcatttttgtatatttatgcattaggtgatgggacttttaaaggtttgaatttattaggacacgaactaaaaataaaagtgcactaggggacagttgatttcaatctaagaaaagttaacacttgggaattacaagaagtaaaacaagtgcaactaaatcatttattagttgttttttgaaagcagttttatgtataaataacaaatgtttatatttaactaaatgtaaggtacgaattattacatattaaacttttcttccccttcctagttctgaagtagatatatatatatatatatctactgtcacattccatatattttgaatatttaactcatctagttaataatgtttttattccatgcgaatgatttgatattttcatccttatttctctttggctacaatttatattgagttatatctgtacattctggtaatctaaaatccttaaaaatactctaatagccttgagtgaccaactttttttttaaagcacagatgtaattgtctaatgttctgatgggaacgtaacacttatttttatataaaaagagactgagtaaacaaacattatagaaaaaaagtgaagttttttagttgttttttgtggtattcaaccagcaagttgttttctttcagagtttcctccttcaaaaagttatattgcatttacaaatgttttacaaggcagaaagtttgactggatagttagtgtaaaagcttcatgttgagatcttcacgtatcattctgctaaaccagaatatgttcagctgtgttactaatttttcagcttaatcctcagtgcttattatttacataacaataactttttatcagttacattttatttttatttaaactggccaaaagcaaaattattttatgttaaaatgtgtgctaaactatcccaggaaagtatttaatccaacattgtaaatgaagtatcttgtacatataaatttatttcttttgcagagcattatattactggatgtttaatttacaaaatagttgggtaaatgttccaacaaactttaaagtaccttgaagtcaaattgtctgtttttgttttgttgttgttgttgttgttttcttaagtgttacattaaaactctaaccaaggaaagggttctttaagaacattcccttagagggataaagttgagaagtgtgccttttttttaatggcttgaagtttcagaggtgataaaaattaaaatcacactactatttgaagctcattttctatgcaggtttttaaacgtcatttatgtatcattctttttatatatcacacttaagcttgtgttagcttttttcttttgccccagatcaaactgaacaatgtatataacactatctgtctgtaaaatactttttttaagaaagcatttatatttatatgacagcttgaactgacaacattgtgtatatagatcatcttgaagtattatttcacattgaaaagaagaaaatatattgataactatagatgttatgaagaagagggtatttctagttttgtactaaaaatcaattggatgaactaaatccaaaacatgacactgtaggcagcagttttaagtcttatttttactgtttatatatttgaatgctgctacaacagatgatcttcatccctgaagttttcagctaaacttggtttcctagaatagactgttaactttcaaaatttttattggtgaaatggaaatactgtttttccttgtgaatgaattttcatatttgtaagtgctaagtttataattcaggtttgatcaaggtgtgaataactgaagaaaataacttgctggctatataggaaaatgctgtggaaatgaactgtgtatatacttctgggaggaacaaatttaatcatttcttctgttaagcactaatcagtatagtgcaactcctggttctgtactgtattttatatgcaacatatatgctttaatattttaatgtttgtgcattaatattttcaatttgtttaaccactttgctgctaagattttgccgtcccattcccattttttcctttacaattttaaacaagtttcttcattaaaaactatggtgatgaaatggtttttattttaccttggatctttatagttaacatacccagtttcttaatcagtctacaagactaactgatgatataatgttctctgaatccctatatggaaattttcttttgagtaaatgagaattcctttgtgaaagcaaatgggtagtttaaatcactgattcttaaacatgtgtataggcaccttcaggaacattttctcattctctgtacagattcggcactgccaattggcttttcctctaaaacttttctttgtttttatctgatataagcagatggctcaagacaactgcttgagtaatagtattgaaaatggaatcatctagacggcatgacaagcaagactggtctgatgaacttgttcagaattgataattcttaaatatttctcttggcttcaaaagggacatcatttgatttctgaagaagtatgtcgtgtggagcttcagcaccacctactggatgatttccaggccagagacatgagatggcaatagggatctgacagggttcatcactactaccattaaagggctatttatgtggtgaccacctctaccagggaaaccaggaataagaactgtctcaaaggaattgtaaaatggttatttacctaatgtgtcttgttggcttgctgaaagattttaagcacttttttcttacatatcctgttttaaaatatttgttgatatttgggactggcaatcaaacttaatggatgtactgaggcatttatagaaccagttgctttaactctcaaaagccattaccaaaatggtatttttttcctccttccgccagtcagggagaatttttaaaaataataatcaaaacatgaaaaaacataatcacacctgtattttatcatgacagcttcagagagtgtgtgtgtacgtttttctctcttttatttgagacggagtttcactcttgttgcccaggctggagtgcaatggtgcgatctcagctcactgcaacctccgcctcctgggttcaagcgattctcctgcctcagcctcccaagtagctgggattacaggcacccaccaccatgcccagctaagttttggtattttagtagagatggggtttcaccatgttggccaggctggtcttgaactcctgaccttaggtgatccacccacctcggcctcccaaagtgctgggattacaggcatgagctactgcgcccagccgtgtgtatgtttctgaaatgatgatggggtggggttaaaatctaaagggaaaaacttgaaactacctattttcattggttattcagcagtgcctaaaatgagcttttgaagtaatgtaaatgcactttcaattcatgtgtatagtgccatctgatatcttgggtaagtcttgctttttcttttctttttcctctcccctgcccccttaattaaatggcacggaaatgtttcttaatatgcacgtgagtctccagagtacaggaaatgtgctttcctctaaatggtcaatgtaaagaatcttaaggatatttcttgtgttgaaatttacattcgattttgtgattacacttggaagtatgtgttaaattgggtttttaattgtagcccaaaggtgcattaagcaagtgtaacattttttccacataaaacttagaaaactttagttacctgaaaagcaaggattctttactaattattatgctcattcttgatttgacttccatgttcacacttcaaagtgtaagaggaagcactagaaactggcattattgttgcactaaaaaagtctataaatcataatagcaccatgaggtgttttgcaatgagacaaacatgaagaatgaatttctttaagagagaaacacaaccggaggtgatttatataaaccaaaagaaaaaaaaaggctttaaggtattaggtactgtttgcctagcagccaggtggttataaaagattcatatgctttggtacactgataaatgttagccattattcctgaaagcttcttaaattgcatcagttgttttgaaattttttcaagaataaactagttgaaaagtctttgtattaaaaatacacatagatttttgtgaacatttccagtgtgtagtgtcgtttgctttctatttctgacctcaaaagtgcctcacttgtatattatttccattaaaagcttgactgcattctttctaatgaacaatgaaaaactgtttaactcatgtcataatgtgtctcctcagatatagttaactagcttgatagttttgagtatataatgtaaataatacattataagtttgtaaccatttctgttacttcatacccgtgtaattggacatagcagatgattatcataagaatttgttttaatggtttttttccctcctggaattacctgattaaacctgtcatgaattataaaaggactttttcttattctcctagagcttatcaaattatcacataagagataattactggaggagaaagtaaaaatggaagcttttgataattagctctgttctttaaaagtatacttttaaactgaaagttcacatatagttcatcttaataacatatttattcatccttaattgtattcagatttttttttaagtctctaagctaataatgttatatttattggtttggtaacatgttgcagctaagctaatgaccttaagtggcaattgtttaacccaggactactgatttttttatattcaagtcagtttcatcgttttacttaactcgccatataaccaaaaataacgaataatctaaaggaaaggttattaggacagtaataaaaaattatagtgtatctcaacactagaataagttggattactatattatagtttatttgaaaaatcaaggagtaactgtatctttaccattaattatgaaatgtagtctcatgtgcttatttacaggtttttcagaatttgctttacattcttcacatcaagttaatacccacaagtaagtagaatagcttttataacaaggaaattgaaactagggttctagcttggctatcaatataagtgtcatgcacatagtgctccttaaagaaaaagacatcgacatcaatggtatgaaagctgtagtcactctttaaattgaactgctctaagatttgcagttttagtgagatctgaaatgatggttcaaaaaatacattcataataaaagtcttaacaaaatcaca

SEQ ID NO: 105 - DNA, 2781 bp, Homo sapiens
gtccgtccttcctggtcctgcgggtccaggactgtccgcggggttgagggaaggggccgtgcccggtgccagcccaggtgctcgcggcctggctccatggccctggtcacagtgagccgttcgcccccgggcagcggcgcctccacgcccgtggggccctgggaccaggcggtccagcgaaggagtcgactccagcgaaggcagagctttgcggtgctccgtggggctgtcctgggactgcaggatggaggggacaatgatgatgcagcagaggccagttctgagccaacagagaaggccccgagtgaggaggagctccacggggaccagacagacttcgggcaaggatcccagagtccccagaagcaggaggagcagaggcagcacctgcacctcatggtacagctgctgaggccgcaggatgacatccgcctggcagcccagctggaggcaccccggcctccccggctccgctacctgctggtagtttctacacgagaaggagaaggtctgagccaggatgagacggtcctcctgggcgtggatttccctgacagcagctcccccagctgcaccctgggcctggtcttgcccctctggagtgacacccaggtgtacttagatggagacgggggcttcagcgtgacgtctggtgggcaaagccggatcttcaagcccatctccatccagaccatgtgggccacactccaggtattgcaccaagcatgtgaggcagctctaggcagcggccttgtaccgggtggcagtgccctcacctgggccagccactaccaggagagactgaactccgaacagagctgcctcaatgagtggacggctatggccgacctggagtctctgcggcctcccagcgccgagcctggcgggtcctcagaacaggagcagatggagcaggcgatccgtgctgagctgtggaaagtgttggatgtcagtgacctggagagtgtcacttccaaagagatccgccaggctctggagctgcgcctggggctccccctccagcagtaccgtgacttcatcgacaaccagatgctgctgctggtggcacagcgggaccgagcctcccgcatcttcccccacctctacctgggctcagagtggaacgcagcaaacctggaggagctgcagaggaacagggtcacccacatcttgaacatggcccgggagattgacaacttctaccctgagcgcttcacctaccacaatgtgcgcctctgggatgaggagtcggcccagctgctgccgcactggaaggagacgcaccgcttcattgaggctgcaagagcacagggcacccacgtgctggtccactgcaagatgggcgtcagccgctcagcggccacagtgctggcctatgccatgaagcagtacgaatgcagcctggagcaggccctgcgccacgtgcaggagctccggcccatcgcccgccccaaccctggcttcctgcgccagctgcagatctaccagggcatcctgacggccagccgccagagccatgtctgggagcagaaagtgggtggggtctccccagaggagcacccagcccctgaagtctctacaccattcccacctcttccgccagaacctgagggtggtggggaggagaaggttgtaggcatggaagagagccaggcagccccgaaagaagagcctgggccacggccacgtataaacctccgaggggtcatgaggtccatcagtcttctggagccctccttggagctggagagcacctcagagaccagtgacatgccagaggtcttctcttcccacgagtcttcacatgaagagcctctgcagcccttcccacagcttgcaaggaccaagggaggccagcaggtggacagggggcctcagcctgccctgaagtcccgccagtcagtggttaccctccagggcagtgccgtggtggccaaccggacccaggccttccaggagcaggagcaggggcaggggcaggggcagggagagccctgcatttcctctacgcccaggttccggaaggtggtgagacaggccagcgtgcatgacagtggagaggagggcgaggcctgagccctcacacatgcccacgctcccctgacactgaagaggatccacaactccttggagaaacaccctcacgtctgttgccgcacacattcctctcagctccgccccatacccgtcactacagcctcacctcccacccctgtcactacggcctcacctcccacccctgtcactacagcctcacctcctacagccttaagtcccaggcccatgtctgcctgtccaagggctcaagactttctaactgggatgtggtagagggactgaaggtacctttgggggcaacagcaccctagtttcattctcaactctagccctgcacactcacctgtggcacggaatgaaaacagagcttcccgtgcaaaaagggtcacgcctcccacccccgccccctccctgcacctcctgtcctctcccagttcattcctggaaccagccaggccaggcaaccagtggcccccaaaggcaggcaggatcctcaggccccagccgcgggaggctggaagggctggcagatcgcttccctcatccacctccaccggtccaggtctttgctgctgtccccagacctcctgtgacaccacgccagatcacagggcaccaggccagagatagtcttctttttgtcctttctggcctctggctagtcagtttttcatagccttacagtatctggctttgtactgagaaataaaacacattttcata

SEQ ID NO: 106 - DNA, 2158 bp, Homo sapiens
agtccttcagcggccgggttcgcgccgcggtcgccggctgcttacgtgggcgggcctagtgtggggctgagggtgcgggtcgctatggcggtggacatcacgctgctattccgggccagcgtcaagaccgtgaagacgcggaacaaggcgctgggagtggcggtgggcggcggggtcgatggcagccgggacgagctgttccgccggagcccccggcccaagggcgacttctccagccgggcccgcgaagtgatttctcacattggcaaactgagagattttcttctggaacacaggaaagattatattaatgcttatagccataccatgtctgaatatgggaggatgacagacacagaacgagaccagatagaccaggatgcccagatattcatgaggacctgttcagaagcaattcagcaactacgaacagaagctcacaaggagatacattcccagcaagtgaaggagcacaggaccgctgttttggatttcattgaagattacttgaaaagagtatgtaaactttactcagaacagagagccatccgagttaaaagagtggtggataagaaaagattatctaagctggaaccagaaccaaatacaaagacaagagaatccacatcttctgagaaagtttcacagagtccttcaaaagactctgaagaaaaccctgccactgaagaacgtccagaaaaaattttggctgaaacacaacctgaattgggaacgtggggagatggcaaaggcgaagatgagttatccccagaagaaatacaaatgtttgaacaggaaaatcagcgactaattggtgaaatgaacagcttgtttgatgaagtgaggcaaatcgaagggagagtggttgagatttccagactccaagagatattcacggaaaaggttttgcaacaggaagctgagattgacagcattcaccagttagttgtgggggcaactgaaaatatcaaggaaggcaacgaagacataagagaggccattaaaaacaacgctggcttccgcgtgtggatcctcttcttcctcgtgatgtgctccttctccttgctcttcctcgactggtacgacagctagccagggccacgggggcccagcacgagagtcctcatgggcactcacagactgcgtgctttcatgtacttccagtgctggagcatggtatgaccagattttatcacagtgccatttgaagggaaaggagttcagacagacagacgtattccccaaaaagggataccccaggccgatggtgttcagccatttagcagctgaaaaaggaaacagtgcacaccaatgggaggcagcctgcgtagccctcatcaggcaagacagactgaatgcaggagtgggtgattagctgctccttgaacttgaggctgccttggcagcaggggcacagcaggcctcaagagcccctaattgtctcagggttcaaaggaagacactgacctttcccatcccggtagcttcagggaagatcatagttaataacgtctctcaacaaatgattacttctttgtttccttgtggcttcttgtctgtctgagtcaacgaatacacagacttactggattatagaagagaaaattcacatctgccttgttaatctaataaatataattacagccccttaatgtgttgtcaatgagtctaagttgacaaattcagtggcagcccagccacctcctatcaatcaatcagggaagaaatgcaggggagactggggccctcagtgaggggctgcctggcattactcctccaaagactgctgcccccagaacaggcagggggtgtgggagggccagtttcccgccactgggtccaaggagcctttgttcaaaggaagaagtgggccacggaagaacgggcctgcttctctcgtgcctgtgcttctgacctccaggaactgtaaacaggaacacctatgtgtaactgaaggcatgagacatctgtacaggaagcatcccagcgcccacatgggcatgagacagtctgcactgcgcctggtgaaatgcgtgtgtgtacagacagtccactgggcagcacaggtatcctcatgttctttatttgcacagagtgaaatgtcagaagttacatgtaaatgaattcacagtcaataaagtccacgtctacctggaaa

SEQ ID NO: 107 - DNA, 4002 bp, Homo sapiens
gctctgggctgtgcggcaccgcctctcctcggtgtctggggagggacggagggaccgggcgggagagagagaaagcctgaccgaccggctggcgaagagctgcatgcaaccggtgggaggccgggccggctgggtctggggctcgggctcaggctcgcaccgtttctcggcaggtccctggcggtgagcgcggacggcccggaggcggcggctctgagctggcaggcggagggctgtctcctgcgcccgcctgcccggcgcggtccgaggatgcgggggggcgatgcccggggccagggacgcgctctgtcaccaggcgctgcagctgctggccgagctctgtgcccgtggggccctggagcacgacagctgccaggatttcatttaccacctgcgggaccgtgccagaccccggctccgcgacccagatatctcagtgagcctgctgacccttgtggtcactgcctgtggtctcgctctctttggcgtgtctctcttcgtatcttggaaactctgctgggttccgtggcgagaacgaggcctgccctctggtagcaaagacaacaaccaggagccccttaactacatggacacagagaccaatgagcaggagaacagtgaggacttcctagatcctcccacgccctgccctgactcctccatgaagatcagccacacctcccctgacattcccctctccacccagacggggatccaggagaactgtgcccatggcgtccgcgtgcagcgccaagtcacagagccaacctcgtcggcccggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatgacaacgtggatctgggagagctgatgttttccctgtgctatcttccaacggctggcaggctgaccattaccattataaaagcaaggaatttaaaggcaatggacataacaggagcatcagatccctatgtgaaagtctcgctgatgtgtgatggcagacgactgaagaagaggaaaacatccaccaagaggaacaccttgaatcctgtttacaacgaagccatagtctttgatgtccctcccgagaacattgaccaaatccacttgtccatagcagtcatggactatgaccgtgtaggtcacaatgagatcatcggcgtgtgtcaagtaggcaacgaggctgagaggctgggcagagaccactggagtgaaatgttgtcatatcctcggaagcccattgcacactggcattccctggtggagaaacgatgaccatgggtaagaggactgcttgtgccaaggacaaaataggacaaccatctcacaaagatcttaagtaactttttccatccagcaacatccagacgatttcagtgaccaaatgctcagctgtaaccacagcactaactggccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacctaatggtcctctctgtcccattataggtgcaaggcaccccatccacacatttgcaccactactccaagatagtatttttcttttcacacaatctctttacagcagaatccagagttggattgtagtttaccttcctggaaagctcattatctctgtttgaattaacatttcagcatggaactaactgggcggaggaaggatcgttatacgtcttcagaaagttctcattgccccagctgcctagtactatacaagaagctctactttgatggcagatctaagaaggctataggcctttgtttgtaggaagcagtgtcattacattcaagcttcacttctctgattggcttccaaccactgggattcaaagagaatccaaggttctgcctatgtctgatgacataaggaaaacttggcttcctctgctcaaggttcccctctgctcatccctcctcattcagacatcctccaccataccagtgtttagaagcaaaacatgaagggctagcgccaccaggatagttagcagaaatattgtctgtaaagctaggcagatgagcccagaagaatggtcccagagaaagcagactggctccaatagatatcaggcagcaatcccaataaattctgacatgtccttggcaatggaagcctgggttggagatcctgaggcagctgtgcctactgttccccacctcagaagcttcctgcccagagagccagcagccttgggatactaatgaggatgcaactggcttattggtatgaaatagaaggtggctttgtaggggcaagcaggcaaagagtactatccacatggcaggcaggtggctttgtgtctggaaagctttgcctagccagtacagctgtgagcagaggctggttataaatttgaactccctcagcccatttgcaactctgcctctgttctcttgcattctgtttggttgccctttagtttcctagtaaatgctccttttgaaaaac

SEQ ID NO: 108 - DNA, 1936 bp, Homo sapiens
agctgctggctgggctgcctgttgagtcagccttcttccctcacggctcttctcccggtccctgaaactcggctgccaggggagctggagccacctgcgaaggtgtcctcccatactggacccctacaggaagctccgtgtgcccagctggggcacagccccagctgatgccccagaggggccacccatcgcaagaggggctttgggctctgccctccctccccatggcgcatgggccaaagcctgagactgaaggactgttggacctcagcttcctgacagaggaggagcaggaggccattgctggcgtcctccaacgagatgcccgcctgcgccagctggaggaggggcgggtcagcaagctccgggcctcagtggcagaccctgggcagctgaagatcctgacaggggactggttccaggaagcacgctcccagcggcaccacaatgcccacttcggctctgaccttgtccgagcgtctatgcgcaggaagaagagcaccaggggagaccaggctccaggccacgacagggaggctgaggctgctgtgaaagagaaggaagaggggccagagcccaggctcaccattgatgaggcccctcaggagaggctcagggagactgagggacctgatttcccatcgccttctgtccccctaaaggcttcagatcctgaggaggcgtcccaggcccaggaagatcctggccaaggagaccaacaggtctgtgccgaggaggctgacccggagctggagcccgcgtcggggggagagcaggagccgcggccccagcaagcccagaccaaggccgcgtcccagatcctggagaatggggaggaggccccggggcccgacccctctctcgaccgcatgctcagcagcagctcctcggtgtccagccttaactcctccacgctgagcggcagccagatgagcctgtcaggcgacgcggaggcggtgcaggtccgcggctccgtgcacttcgcgctgcactacgagccgggcgccgccgagctgcgcgtgcacgtgatccagtgccagggcctggccgccgcccggcgccgccgctcggacccctacgtcaaaagctacctcctcccggataagcagagcaagcgcaagacggcggtgaagaaacggaatctgaatccggttttcaacgagactctccggtactccgtcccgcaggccgagcttcagggccgcgtgctgagcctgtctgtgtggcaccgcgaaagcctgggtcgcaacatctttctgggcgaagttgaagtgcccctggacacgtgggactggggctctgagcccacctggctccccctgcagccccgggtcccaccctctcccgacgaccttccgagccgcgggttactcgccctgtccctcaagtacgtccccgccggctccgagggcgcaggactgcccccgagcggggagctgcacttctgggtgaaggaggctcgggacctcctgccgctgcgggcaggatccctggacacttacgtacaatgcttcgtgctgcctgatgacagccaggccagccgccagcgtacaagggttgtgcgacgcagcctcagccctgtgttcaatcacaccatggtgtacgatggctttgggcctgctgacctgcgccaggcttgtgccgagctctccctctgggaccatggggccctggccaaccgccagctggggggcacacgcctcagcctgggcaccggcagcagctatgggctgcaggtgccctggatggattccacacctgaggagaagcagctgtggcaagccctcctggagcagccgtgcgaatgggtggatggccttctacccctcagaaccaacctggcccccaggacgtagccccaccaagcctctctctctggacccccatctcagggcctgcccttggctaaagtcaataaagtctattctaagagcaa

SEQ ID NO: 109 - DNA, 2799 bp, Homo sapiens
ggagcggcggtgaaggtcctgggtgaggtagggttggatggtgcttgccgcgtatcatggctgcctccggaaaactcagcacttgccgtctccctccgttgcccacgattcgagaaatcattaagttgttaagactgcaagcagcgaagcagctatcacagaatttcctcctggacttgaggctgacagataagattgtaaggaaagctggcaatctgacaaatgcttatgtttacgaagtgggccctgggccagggggaatcacaagatctattcttaatgccgacgtcgctgaacttctggtggttgaaaaggacactcgatttattcctggattacagatgctttctgatgcagcacctgggaaactgagaattgttcatggagatgtcttgacatttaaggtagaaaaggctttttcagaaagtcttaaaagaccctgggaagatgatcctccaaatgtacatattattggaaatctgccttttagtgtttcaactccactgattatcaagtggcttgaaaatatttcctgtagagatggaccttttgtttatggcagaactcagatgactttgacttttcaaaaggaagtggcagagagacttgcagccaatacaggaagcaaacagcgtagtcgcctctctgttatggctcagtacctctgcaatgttcgacacatctttacgattccaggacaagcttttgtccccaaaccagaggtggacgtgggcgtggtgcacttcactcccttgatacagcccaagatagagcagccattcaagctggtggaaaaagtggttcagaatgtatttcagttccgaaggaaatactgccatcgagggctcagaatgttattccctgaagcgcagcgcttggaaagcacgggcaggctgttagagttggcagacatagaccctactcttcggccccgccagctctccatctcacactttaagagcctctgtgatgtatacagaaaaatgtgtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcagagaaaataaatatcatcaaataagatacagtacaagctttcttttaatatatactgtatagatagttatgacatgtttagtataaacagcatctattacaatctatcttacaaaaatgaagtatctgcacattttgcccctaaaccacattaaaataacttaaatatgctttaaataaagcaaaaactaacaaacagctgaaagaaaatgcccagaggattttaaaaaatggccctttgaaaactattaatcacgacttccccagccttactttttccacataacttaattattagaatgtaattttaaggatcctaaatcatttgatacctgctcaaagtggatataaactaagtaatttacagattctgaccagtttcatctaggtttctgatccacaataaattaaaataacttaaatctttacaaccattttgtgggaaaatgtatactgcacaaaacccaggaatgaacagtttttttttttttttttttttgcaatttccactttaccaccagtttaaaagtaaaatgaggaatttaacccatatctggattgaatcatactatgattttccgtggctctctgtttcataaaaacactcctcactgacaacagatgttaaactctggacactgaattctcgctctagaacagaatttaggtcgatggtggcattttcagactgactgtcaagggactggtgacggatctgcgccttgagcaaagttcctctgtccctcttggtgctgttggcttttcgtttaatggggcagaagtgcccccggaccagtttgggctgctctcctcctttctgaccctcacccgactccgggccaggctgctgctcagcctcggggtgaacgtctgggtcctcggaaatcctcagtctctggaactgaatttcgatgtctttagtagggctgccctgcttcacagtctgacggtggtcatcatcttcatcgctcaggatgtcactctctttgatgagattgtcggcaaaatctgccaagccggggtgtgggtatttcccgggagaagtgctcttggagtcctgcctgccctcagccgtggggcagccgctgctctgggtgccgctgctcaagctgccctcgtcagagtccagcaaggttcccttgccagtctcaccggtccactcgttgctggaggaattcttcaggacttttaaagacctggatgaagctacagtgagaaaaacacatttcgctgtgatacagaaacaggttacacaatgtgtaatgtttgcctcaaagcttgtgtaagatttaacattaagattttattttatgatatgacttcagttagcaactatcctggtaattaggcaaaaatgtagctactgaaaacatggacatttttgacttaggtttacagttgtaagttaggcaattcagcatttttagattaccagagctcaattatgtaaatagaactagacactagaaactactacatgggctaagattcttattttgccaaggagtaagttgaaaagttaattggtaataataaatctaggctcctttctttca

SEQ ID NO: 110 - DNA, 2364 bp, Homo sapiens
ggccgggcgggcatgggccttcccggcccggagctgggagtcgaaggggcgggaggcgtgatggtgaactcgcaagaagtttgagggacgcgcgggccccgcgcccactccccctccaccggacacggctggggccggcgatgcctgagagggggtcggaggacgcagtgaacatatatgcatgtacagtgtggatcctcatctgagaggagggagatgaaaacacacccacctcacaggctgttgtgaggactaagggtgcggcagtgcctggtacatgggagccagcgccggcagccaccatggcgtcacgcatagggttgcgcatgcagctcatgcgggagcaggcgcagcaggaggagcagcgggagcgcatgcagcaacaggctgtcatgcattacatgcagcagcagcagcagcagcaacagcagcagctcggagggccgcccaccccggccatcaatacccccgtccacttccagtcgccaccacctgtgcctggggaggtgttgaaggtgcagtcctacctggagaatcccacatcctaccatctgcagcagtcgcagcatcagaaggtgcgggagtacctgtccgagacctatgggaacaagtttgctgcccacatcagcccagcccagggctctccgaaacccccaccagccgcctccccaggggtgcgagctggacacgtgctgtcctcctccgctggcaacagtgctcccaatagccccatggccatgctgcacattggctccaaccctgagagggagttggatgatgtcattgacaacattatgcgtctggacgatgtccttggctacatcaatcctgaaatgcagatgcccaacacgctacccctgtccagcagccacctgaatgtgtacagcagcgacccccaggtcacagcctccctggtgggcgtcaccagcagctcctgccctgcggacctgacccagaagcgagagctcacagatgctgagagcagggccctggccaaggagcggcagaagaaagacaatcacaacttaattgaaaggagacgaaggttcaacatcaatgaccgcatcaaggagttgggaatgctgatccccaaggccaatgacctggacgtgcgctggaacaagggcaccatcctcaaggcctctgtggattacatccggaggatgcagaaggacctgcaaaagtccagggagctggagaaccactctcgccgcctggagatgaccaacaagcagctctggctccgtatccaggagctggagatgcaggctcgagtgcacggcctccctaccacctccccgtccggcatgaacatggctgagctggcccagcaggtggtgaagcaggagctgcctagcgaagagggcccaggggaggccctgatgctgggggctgaggtccctgaccctgagccactgccagctctgcccccgcaagccccgctgcccctgcccacccagccaccatccccattccatcacctggacttcagccacagcctgagctttgggggcagggaggacgagggtcccccgggctaccccgaacccctggcgccggggcatggctccccattccccagcctgtccaagaaggatctggacctcatgctcctggacgactcactgctaccgctggcctctgatccacttctgtccaccatgtcccccgaggcctccaaggccagcagccgccggagcagcttcagcatggaggagggcgatgtgctgtgaccctggctgcccctgtgccagggaacaggggccggcctgggggctgggagggccaggggcacctccctcccacccttcaggctgcactgtgtgtgaagtagccacctgccctgcctccctcctccccgttggcccctgtttggacttagtgcctgtctggcagcctgtggggtcaggagaagcacccccagggcagccctcttgactggcgcagtgggaagaggccttcagcccctctcccggagatggaatcgcggggcagggaggggcagggtgttctagaggtgagaagagggcctggtggagattccctgtcttctgagcccgagcccctcattaccagtgaaggacatgcttgaggggttcgggaagctcctcatctgaggcaactggtcctgggggtgctcaggcctgcctttttgggactcagatggcaggaggtccaccccgcagcctggtcctcggctctcccacaggtgggcaccccccactttggtgctaatagctctccaccaggtggtgtgagcgcgggggctgccagaagcgggaggggtcactgccggaagagcagctgccctccgacccctcactttgtgcctttagtaaacactgtgctttgtaaaaaaaaaaa

SEQ ID NO: 111 - DNA, 492 bp, Homo sapiens
atccctgactcggggtcgcctttggagcagagaggaggcaatggccaccatggagaacaaggtgatctgcgccctggtcctggtgtccatgctggccctcggcaccctggccgaggcccagacagagacgtgtacagtggccccccgtgaaagacagaattgtggttttcctggtgtcacgccctcccagtgtgcaaataagggctgctgtttcgacgacaccgttcgtggggtcccctggtgcttctatcctaataccatcgacgtccctccagaagaggagtgtgaattttagacacttctgcagggatctgcctgcatcctgacgcggtgccgtccccagcacggtgattagtcccagagctcggctgccacctccaccggacacctcagacacgcttctgcagctgtgcctcggctcacaacacagattgactgctctgactttgactactcaaaattggcctaaaaattaaaagagatcgatattaa

SEQ ID NO: 112 - DNA, 2076 bp, Homo sapiens
atcttgccgtacggcgcggacgccgcgggccggcccacgtcccgagccgtgtcgccgccgcgctccctccctcggggcggtccgcgggcgggcgggcggctagggccggggcctggctgcgcggctgggccaaggcccgcgatggtgatctgctgtgcggccgtgaactgctccaaccggcagggaaagggcgagaagcgcgccgtctccttccacaggttccccctaaaggactcaaaacgtctaatccaatggttaaaagctgttcagagggataactggactcccactaagtattcatttctctgtagtgagcatttcaccaaagacagcttctccaagaggctggaggaccagcatcgcctgctgaagcccacggccgtgccatccatcttccacctgaccgagaagaagaggggggctggaggccatggccgcacccggagaaaagatgccagcaaggccacagggggtgtgaggggacactcgagtgccgccaccagcagaggagctgcaggttggtcaccgtcctcgagtggaaacccgatggccaagccagagtcccgcaggttgaagcaagctgctctgcaaggtgaagccacacccagggcggcccaggaggccgccagccaggagcaggcccagcaagctctggaacggactccaggagatggactggccaccatggtggcaggcagtcagggaaaagcagaagcgtctgccacagatgctggcgatgagagcgccacttcctccatcgaagggggcgtgacagataagagtggcatttctatggatgactttacgcccccaggatctggggcgtgcaaatttatcggctcacttcattcgtacagtttctcctctaagcacacccgagaaaggccatctgtcccccgagagcccattgaccgcaagaggctgaagaaagatgtggaaccaagctgcagtgggagcagcctgggacccgacaagggcctggcccagagccctcccagctcatcacttaccgcgacaccgcagaagccttcccagagcccctctgcccctcctgccgacgtcaccccaaagccagccacggaagccgtgcagagcgagcacagcgacgccagccccatgtccatcaacgaggtcatcctgtcggcgtcaggggcctgcaagctcatcgactcactgcactcctactgcttctcctcccggcagaacaagagccaggtgtgctgcctgcgggagcaggtggagaagaagaacggcgagctgaagagcctgcggcagagggtcagccgctccgacagccaggtgcggaagctacaggagaagctggatgagctgaggagagtgagcgtcccctatccaagtagcctgctgtcgcccagccgcgagccccccaagatgaacccagtggtggagccactgtcctggatgctgggcacctggctgtcggacccacctggagccgggacctaccccacactgcagcccttccagtacctggaggaggttcacatctcccacgtgggccagcccatgctgaacttctcgttcaactccttccacccggacacgcgcaagccgatgcacagagagtgtggcttcattcgcctcaagcccgacaccaacaaggtggcctttgtcagcgcccagaacacaggcgtggtggaagtggaggagggcgaggtgaacgggcaggagctgtgcatcgcatcccactccatcgccaggatctccttcgccaaggagccccacgtagagcagatcacccggaagttcaggctgaattctgaaggcaaacttgagcagacggtctccatggcaaccacgacacagccaatgactcagcatcttcacgtcacctacaagaaggtgaccccgtaaacctagagcttctggagccctcgggagggcctggctactgtgcctcaacggttcggctcctcaacagacagtccctgcggcagaagtgggtgtggccgtgagcctctgcaggctcaagagtgttgtccagatgtttctgtactggcatagaaaaaccaaataaaaggcctttatttttatggctgaggattttgaatatta

SEQ ID NO: 113 - DNA, 2019 bp, Homo sapiens
ctcgctcggtgttcgcccgccgacgccgcacggcttgctggggctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggttctccagagagattgtaccttcagcaaacaatatatgaggataccttctgcaccctcagccacactgaatatcatcagattttttcatctccggcaatctggtagatcagggatggtgaacattttctacaaagggccaacctttctgagaaaagtctacagcattctttctctgcaggttctcttaactacagtgacttcaacagtttttttatactttgagtctgtacggacatttgtacatgagagtcctgccttaattttgctgtttgccctcggatctctgggtttgatttttgcgttgattttaaacagacataagtatccccttaacctgtacctactttttggatttacgctgttggaagctctgactgtggcagttgttgttactttctatgatgtatatattattctgcaagctttcatactgactactacagtattttttggtttgactgtgtatactctacaatctaagaaggatttcagcaaatttggagcagggctgtttgctcttttgtggatattgtgcctgtcaggattcttgaagttttttttttatagtgagataatggagttggtcttagccgctgcaggagcccttcttttctgtggattcatcatctatgacacacactcactgatgcataaactgtcacctgaagagtacgtattagctgccatcagcctctacttggatatcatcaatctattcctgcacctgttacggtttctggaagcagttaataaaaagtaattaaaagtatctcagctcaactgaagaacaacaaaaaaaatttaacgagaaaaaaggattaaagtaattggaagcagtatatagaaactgtttcattaagtaataaagtttgaaacaatgattaaatactgttacaatctttatttgtatcatatgtaattttgagagctttaaaatcttactattctttatgatacctcatttctaaatccttgatttaggatctcagttaagagctatcaaaattctattaaaaatgcttttctggctgggcacagtggctcacgcctgtaatcccaccactttgggagaccgaggcaggtggatcacgaggtcaagaggttgagaccatcctggccaacatggtgaaaccccgtctctactaaaaatacaaaaattagctggatgtggtggcacacacctgtagtcccagctagtcaagaggctgaggccagagaatcgcttgaacctgggaggtggaggttgcattgagccaagatcacgccactgcattccagcctggtgacagagcgagactcagtctcaaaaaaaaaaaaaaaatttttcttcctaaattagccacgcatagcggttcgtttgcaattcaaaaataattttatgagtagataagaatatcagtttaccgttgtctagtgattttatctaaattttccctgaattattaagtaatattgatttggctttgattctgaagtagtagagtctttaccattataaactgtaaatctctttttgcttaaaaggaaaaaaatgtaaaagataaattccacagagaattattcagtattacattaaaatgttaatgactttttattttaaattgtactaacattaaaagttggcctgaaagtcagatattatgacaaaatttgacattaattgtttttaaagtatagatttcatttgaaattatagaatggtaatgtggttagaggacaccaaagatactgggtcatcagccattaagtatatctatttcaaaattaaaatatttgggaagtataaaaaaaaaaaaaaaa

SEQ ID NO: 114 - DNA, 2380 bp, Homo sapiens
agtgtctgcctggtggccactagagacagcccagcctggggccatggaagaaaacccgaccttggaatcagaagcctggggctcctctagggagtggctggccccccgggaggccagaggagccccctgctcctccccaggcccatcgctgtcttctgtgctgaacgagctgcccagtgctgccacccttcggtaccgagaccctggggtgctgccttggggggcgctggaggaggaggaggaggatggaggaaggagcagaaaggccttcacagaagtcacccagacagagctgcaggaccctcacccttcccgggaactgccctggcccatgcaggccagacgggcacacaggcaaagaaatgccagcagggaccaggtggtctatggctctggaactaagacggaccgatgggcgcggctacttcggaggtccaaggagaaaacaaaggaaggcttgcgaagcctgcagccctgggcgtggacactgaagaggatcgggggccagtttggcgccggcacggagtcctacttctccctgctgcgcttcctgctccttcttaacgtgctggcctctgtgctcatggcctgcatgacgctgctgcccacctggttgggaggcgctcccccaggccctcccggccccgacatctcctcgccctgcggctcctataacccccactcccagggcctggtcacctttgccacccagctcttcaacttgctctcgggtgagggttacctggaatggtcccctctcttctatggcttctacccgccccgcccacgcctggcggtcacctacctgtgctgggcctttgccgttggcctcatctgcctcctgctcatcctgcatcgctcggtgtctgggctgaagcagacactgctggcggagtccgaggctctgaccagctacagccaccgggtgttctcggcctgggacttcggtctctgcggggacgtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 115 - DNA, 5516 bp, Homo sapiens
actcctggaatacacagagagaggcagcagcttgctcagcggacaaggatgctgggcgtgagggaccaaggcctgccctgcactcgggcctcctccagccagtgctgaccagggacttctgacctgctggccagccaggacctgtgtggggaggccctcctgctgccttggggtgacaatctcagctccaggctacagggagaccgggaggatcacagagccagcatgttacaggatcctgacagtgatcaacctctgaacagcctcgatgtcaaacccctgcgcaaaccccgtatccccatggagaccttcagaaaggtggggatccccatcatcatagcactactgagcctggcgagtatcatcattgtggttgtcctcatcaaggtgattctggataaatactacttcctctgcgggcagcctctccacttcatcccgaggaagcagctgtgtgacggagagctggactgtcccttgggggaggacgaggagcactgtgtcaagagcttccccgaagggcctgcagtggcagtccgcctctccaaggaccgatccacactgcaggtgctggactcggccacagggaactggttctctgcctgtttcgacaacttcacagaagctctcgctgagacagcctgtaggcagatgggctacagcagcaaacccactttcagagctgtggagattggcccagaccaggatctggatgttgttgaaatcacagaaaacagccaggagcttcgcatgcggaactcaagtgggccctgtctctcaggctccctggtctccctgcactgtcttgcctgtgggaagagcctgaagaccccccgtgtggtgggtgtggaggaggcctctgtggattcttggccttggcaggtcagcatccagtacgacaaacagcacgtctgtggagggagcatcctggacccccactgggtcctcacggcagcccactgcttcaggaaacataccgatgtgttcaactggaaggtgcgggcaggctcagacaaactgggcagcttcccatccctggctgtggccaagatcatcatcattgaattcaaccccatgtaccccaaagacaatgacatcgccctcatgaagctgcagttcccactcactttctcaggcacagtcaggcccatctgtctgcccttctttgatgaggagctcactccagccaccccactctggatcattggatggggctttacgaagcagaatggagggaagatgtctgacatactgctgcaggcgtcagtccaggtcattgacagcacacggtgcaatgcagacgatgcgtaccagggggaagtcaccgagaagatgatgtgtgcaggcatcccggaagggggtgtggacacctgccagggtgacagtggtgggcccctgatgtaccaatctgaccagtggcatgtggtgggcatcgttagttggggctatggctgcgggggcccgagcaccccaggagtatacaccaaggtctcagcctatctcaactggatctacaatgtctggaaggctgagctgtaatgctgctgcccctttgcagtgctgggagccgcttccttcctgccctgcccacctggggatcccccaaagtcagacacagagcaagagtccccttgggtacacccctctgcccacagcctcagcatttcttggagcagcaaagggcctcaattcctataagagaccctcgcagcccagaggcgcccagaggaagtcagcagccctagctcggccacacttggtgctcccagcatcccagggagagacacagcccactgaacaaggtctcaggggtattgctaagccaagaaggaactttcccacactactgaatggaagcaggctgtcttgtaaaagcccagatcactgtgggctggagaggagaaggaaagggtctgcgccagccctgtccgtcttcacccatccccaagcctactagagcaagaaaccagttgtaatataaaatgcactgccctactgttggtatgactaccgttacctactgttgtcattgttattacagctatggccactattattaaagagctgtgtaacatctctggcataggctagctggaatgcttgataagaactgagctgggatgattgaactttcattctttggcttggggagaaaagaagtcctggggaagcaattgagtctcaaagtagaggcaggggaaaaaagagttagggagaccagatctgctgagtggcagcaagagtgagctgcagattacagaaaccagggtgagcaagtttgagtcccacacagggccttctccctttgcctctttccctccctccctgcctgtgataatcagccaggagccagggataacctatgacttgggaaagagatgagttaggcagtcaagggtgacattcaatcagggatccacaagtggctggaaagaaatgctggtcctgtgtcctaactttttccgcctggagagccctcagtgtggcttcttacatttaaaaaacaaaaaggatcagctgccaggtgtgaggcagtccccaagctgagttgtgaggatgtaagcatgaataagtccctgcactcaaaatggtcaaagaattaaaccccatggacttttttggcatctgtatgaaagcttgggttttctgaggactgtcttgctatagttaagtcagatcctagatgaaatatacttgttcatactgtactaggttcttaggaaacaacagaattcctcaaatgccaaaaacaaagaaaatagaaacccagaaaacaaaacaaaataaaacaaaaccatcagaactgtgagtggaaactaaggtgatgatctgggagcaatacactaaaatcttgggtcgagacctatatgaaggctggcagtggagctaaacctggacacactgaagacaagggagctgaaccagggctcctacatgaagcagggataactgatggcagtaaatgtggtctcaaattgcagatggtctggaggaaaatttcccaaatttagagcctcaggattcccaaagatcctccaaatatgagctcacaatcaaagatcagagacgttgaaaaataaaaaacaccttaagtgggcagcataaaaaacagctaatttagaaccccaaaggcttcagatgtcagaatattagagacttatgataataagcaatatttgcagagtatttgtatgtgccagacactattgtaagtgcttcatcatgtactgattcatttaatactcacagaaatctgtgagatgggtattattcttatcctcactctatggattaaaaaaactaaggcacaaagtggttaagctccttgcctgagattatagactgtaagttgaacgtgagcacttggaatacagagttcatgctgtaaactaccacactatagggcctccaatatgataatttataaaatatttgaataaaaaatgaatactagttccacattttaaaatcatgtttaactgtggtcaaatgcacataacacaagttgccatcttcaccatttttaggtgtatagttcagtggtgttatgtacattcacactattgtgcagtcatcaccaccatccatctccagaacagaaactcagtacccatcaaacaactctccatttccccctcctcccaatctctggcaaccaccattgtgctttcagtctctgtgaactggattactctgggtacctcatttaagtgaagtcatgcagtattggtctttttgtacttgttttatttcacttcacattgtgtcttcaagtttcacccatgttgtagcatgtgtcagaatttcttccctttttagactaaataatattctattgtttatacgaacattcaggttacttctatcttttggctattgtgaattatgctgctgtgaacatgggtgtacaagtatctctttgaggccctgctttcaattctcttgggtatattcccagaagtggaattgctggatcatatggtaattctattttgaattttttgaggaactgatatattgctttccatagagactgcaccattttacattcccatcaacagtttgcaggagttactatttctccatatcccccctaacacttgctattttctgttaaaaatggatatcttaataatcaagcaaaaataacaggcagatttgaaaaagaactgaatacagcttttagaaataaaaactataattataaaaataaaaaactaagtggatggggtaaataacaattaaaacaccaattaagagagaacaaatgaactggaagataaattgaagaagtgactaggcttaacagcagagagagataaggagattaaaaatatgaaaacaaggccaggagcaatgaagcctagaatggtaaattctaacatatccagaatcccagaaagagagaatcaagacaatgagagagagacagtaccaaagagataagagctgagaatgttccagaattgataaaaggtgtgaatccacagaacatacaccaccatagtgtacacgcatacaaccaaggtggaaaaattagaataaatccacacctatgtacattataatgaaactgcagaacaccaaagacaaaaagaaactccttatagcagcagagagaaaacccagaccacccacagtaccacaaatctaccacaattagactgacaacaggctttcccacagcaataaaggagctagaagtcagtggaagtatatctccagcatgccaaaagataacaatcaatcagggattgtgaaccctacaaaactatctttcaagaataaaggcattttcaagaaaacaaaaacagactttaccatcaacaaaccttctctaaaagaatatataaagcatttactttaggaagaaggaaaatgatcctaaaaggaagaaccaagaagcaagtagcaatagtgaggcaattgtgaaaatgtaggtaagtctaaacacactctgtctacttcttcttcttcttcttcttcttcttcttcttattttgagactgagtcttgccctgtcacccagactggagtgcagtggcaggatcttggctcactgctatctccacctcccaggttcaagtgattcttctgcctcagcctcccgagtagctgggattacatgcacatgccaccatatccggctaatttttgaatttttagtagagatggggtttcactgtgttggccaggccggtctcaaactcccgacctcaagtgatccccccgcctcggcctcccaaagtgctgggattacaggcgtgtctacatattattaaaataacaataatatttattttgtgggttaattttttttgaaacagatattgaatttattggttggctatgagtagaaaaatacatcagtaaagaaaaaagaccctgtatataaatataatactagctagttaaaatttgaccaagaagtttccattgtgggttaatttttaaaggcctaactgaaatatggagtaaccacagcatgcagcatgtaaattaaaggggatagctgg

SEQ ID NO: 116 - DNA, 4814 bp, Homo sapiens
cttcgtgccacgtcaccgcctgcgtcgcttccggaggcgcagcgggcgatgacgtagagggacgtgccctctatatgaggttggggagcggctgagtcggccttttccgcccgctcccccctccccccgagcgccgctccggctgcaccgcgctcgctccgagtttcaggctcgtgctaagctagcgccgtcgtcgtctcccttcagtcgccatcatgattatctaccgggacctcatcagccacgatgagatgttctccgacatctacaagatccgggagatcgcggacgggttgtgcctggaggtggaggggaagatggtcagtaggacagaaggtaacattgatgactcgctcattggtggaaatgcctccgctgaaggccccgagggcgaaggtaccgaaagcacagtaatcactggtgtcgatattgtcatgaaccatcacctgcaggaaacaagtttcacaaaagaagcctacaagaagtacatcaaagattacatgaaatcaatcaaagggaaacttgaagaacagagaccagaaagagtaaaaccttttatgacaggggctgcagaacaaatcaagcacatccttgctaatttcaaaaactaccagttctttattggtgaaaacatgaatccagatggcatggttgctctattggactaccgtgaggatggtgtgaccccatatatgattttctttaaggatggtttagaaatggaaaaatgtgatgcaaaagaaagaaatccctgcgctttctgtctgtctttgtggcggcccagattgaattggggaatacatctttagcctggaaatgtaggctgcatgttaatggtaatgtaacttttgcagtgtaatgtttgaaaaatattaatgtagtttttgcttttacagtaacaaatgtggcaattattttggatctatcacctgtcatcataactggcttctgcttgtcatccacacaacaccaggacttaagacaaatgggactgatgtcatcttgagctcttcatttattttgactgtgatttatttggagtggaggcattgtttttaagaaaaacatgtcatgtaggttgtctaaaaataaaatgcatttaaactcatttgagagaatgccttttagtttaatgcatatttaaactaaattgatcctgtagtgttcctggagaagctagagcctgattgtaggctactactcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaagcaactttgtctcagcttatttcacataaagagagcgaagtcttttgggatgaatgttaattaaactccctggtaactagaacagggactggcaaactagcctatctgaccacctgttttgtacactttaaggtggttggttgcctttttaaatggttgaggggaaaagaataccttgtgggatatggaatttaagttcgagtccagttttattggaacgtggctatgcttattcatttatggattgactgtggctgttgtcagtgcatgagcagagttgtgtctaacagactagagcctgcaagtttgccagcccctgatttaaaagatgaaggtacacagaatgtgggctggctggtgggcaaaggggtaaaaatgttctctatattgtatctgaaaagatggggtgtctgaataagaaaatgcatctatttgacagacctggagcagttgctatctgctgctatggtttccaccacagatgcaagaagaacatgtccttgcgctttccgtctgtctaattgtggcagctgagattgaatagaggaatacaggaggaaaaaaagcgggaagagtttttgaggcaggtcggtcacccaggcttgtagtgcagtggcacaagcaactcactgcattctctgcatcctgtgctcaagccattttcccacctcagtctcactagttgctgggactgcaggcatgcacccctatgcccagctaatttttgtagagaccgagtatcgcttagttgcccagggtggtctcaactcctgggctcaaggagatctgcccacctcagcctcccaaagtgcaggcctagcctgggaggggaattttcaaaacgtgagttttgggaaatagtctatcagccttacctggttgattacacttgtaaaagaaagattaaaagcaggccagtgactctggtctgcttgaacatgtgaatgtagtggtttgagcaatctggagtttgccctagtgtcaaattccagactgtccatagtgtccaaaacctgaggcagatactaatgttaacccccagcaccccgtgattggaaacaaacctaaatacgtattgggaacttaatagcaattttaagcattctgatagattttttgtagggatggggtcatgccatgtggcccaggctggtctgaaaactctggcctcaagtgatctcaagctttggccttctaaagtgttgggattacaggtgtgaggcattgcacctggcttagcgttctgatttgacattgtaatgaaaagtgtgagtctcatctacagggccttttgtcctctgaaatgatagcaggaagggaattttcaggcagtggtcaaagctggggaaaccaggatagtgaagaaggccttgaggtgagagatggaagctaattggtgaactagccttggaagcctgaaacagacaagtagcaattcagagactttgtgggctccactgctccaacttgttttgaagattttcagttctgcagaagaggtatttccccagttgtcctttcagtgctcttagctgttttcccaacatccagatccaatcaaggctgggacatagcattttatcatgtctatttaagtcagaagtgatgaaccccagctgtttacctcatggtaaacctttgaagattccaggtagaatcttctcagactttgaagactgtctcattttatatctttttctcgttattcctagggtcaagacgttttgggcaagaataaggatgtgaacatcagaaagctcataacattttgtttttgatgctaagtttaacaaaggcatgctttagtagcctgtgggccctagggtttgttaaagtgtggagaacaactgagtggagcaagaggacttttctaggaaggtccttgtaatgtgacatttgaaaacaaatgaaggtgtggaagtaggccatgtggatatcaggacaaaccattccaggccaagacaacagcagttagtctggagtgtgatgtgttctgggaaaaaagtggccactttgctaacccaagaagacaggaagggttgtaaagcagtgggagtgtgcaaggaaggaagaccagacctcaaggaaaccacaggcgctctgagcagaagagttacatgatatgactcaaatttttaaaggatcactttggctgccaggtggcagggtaaaagcatagaataattgtgtataatgtgtttttaaggcaaagatagtggcttagtctagggtagtagactgaggtggtaggaaatgaagatagagacaacaggatatgctggtgggtgaggatggatttaatgttgatacaagtattttggtctgagcgtttggaagaaagttggcactgaggtgggaagtcgagtttagttttgttagttttggatgtgttaagtttgagatgctgattcttcagagaagtctaagctggagaactatatagagagtggaaagataacaatagacattgaaagccatgatacaggataaggtcatttggagagaggatagactgcattccaacatgagattggttgacaaagagaaaccaacaaaggtaattaagaggtgctcccactgcacttgtactcagaaggctgaggtaggattgttagaggccagcctgggcaccacagggagaccccatctctaaaatttagccaggaaccatggctcatgcctgtagccccaggaatttgggaggctgagtggggaggatcgcttgaggtcaggagtttgagaccagcctgggcaacatagggagacctaaaaaaattaattgggcatctgtagtcccagctactcaggcggctgagctgagaggatggcttgagtccgagagattgagggtgcagtgagctgtgatcataccactgcactccagcctgggcggcagtgagacactatctgaaaaaagtttaaaaattttaaaaaagaaggaactgcccctgaggtaagaaccaagggagggcctcccagaggtcaggtggaaaaagttttaggaaggaggaagtagtcaacagggttacctgttgcaaagtacttaagtaatatgaggcctgatagtggtaaacttgactaccgttggatttcactagtgggaaaggaagtctaattaaaatgcactcaagagactaacagtcgcaggcatgaaatacaatacaggtacatggttttttattatgtgtgcatctgcttcagtaataggtgtgaattactcatttggatcattaggagtttcaaaatctagttaaatgactagatttttgttgatgtaaattctgtcattctgaactgcagggattgtcagtaacttaactgcaaactaaactggtgataattatggtaaaattgcaagacgagcaataaatctcaaccaacttgagagaacactgataa

SEQ ID NO: 117 - DNA, 812 bp, Homo sapiens
agttccggtgagtccgtgggtggggtccccacctggttggaaggctgtgggtccgggaacccgagcccaaggagtgggggcggccccggagcgaggctcacactccctgccctgcagatgactgtccacaacctgtacctgtttgaccggaatggagtgtgtctgcactacagcgaatggcaccgcaagaagcaagcagggattcccaaggaggaggagtataagctgatgtacgggatgctcttctctatccgctcgtttgtcagcaagatgtccccgctagacatgaaggatggcttcctggccttccaaactagccgttacaaactccattactacgagacgcccactgggatcaaagttgtcatgaatactgacttgggcgtgggacccatccgagatgtgctgcaccacatctacagtgcgctgtatgtggagctggtggtgaagaatcccctgtgcccgctgggccaaactgtgcaaagtgagctctttcgctcccgactggactcctatgttcgctctctgcccttcttctccgcccgggctggctgaagcaacctacctcaagtctcaggagaattcatgtctgcctggggcccttccgaacctgtgccaactaagggcccccactgtaagcccccgcacccccaccccctgcccagagcaacagcctaaaggcctgccctgatgctctcctcctaccagagtgaagcccacagagtccctccacctccacaccaggccctctctccagttttatcccctgcctaatgctgcgagaagcacagaataaactttttgtcactctc

SEQ ID NO: 118 - DNA, 2864 bp, Homo sapiens
agtgggccctcggcgcccagctccgcgtcctgtgaggtccagtggccgcccaggcgcgaccagatctgggtgcgcggagagcgcgcatggcggctgtgggaccgcggaccggccccggaaccggcgccgaggctctagcgctggcggcagagctgcagggcgaggcgacgtgctccatctgcctagagctctttcgtgagccggtgtccgtcgagtgcggccacagcttctgccgcgcctgcatagggcgctgctgggagcgcccgggcgcggggtctgttggggccgccacccgcgcgccccccttcccactgccctgtccgcagtgccgcgagcccgcgcgccccagtcagctgcggcccaaccggcagctggcggcagtggccacgctcctgcggcgcttcagcctgcccgcggctgccccgggagagcacgggtctcaggcggccgcggcccgggcagcggctgcccgctgcgggcagcatggcgaacccttcaagctctactgccaggacgacggacgcgccatctgcgtggtgtgcgaccgcgcccgcgagcaccgcgagcacgccgtgctgccgctggacgaggcggtgcaggaggccaaggagctcttggagtccaggctgagggtcttgaagaaggaactggaggactgtgaggtgttccggtccacggaaaagaaggagagcaaggagctgctgaaacagatggcagcggagcaggagaaggtgggggcagagttccaggcactgagggctttcctggtggagcaggagggtcggctgctaggccgcctggaggaactgtcccgggaggtggcacagaagcagaatgagaacctggcccagctcggggttgagatcacccagctgtccaagctcagcagccagatccaggagacagctcaaaagcctgaccttgactttctccaggaattcaaaagcacgctgagcaggtgtagcaatgtgcctggccccaagccaaccacagtctcttctgagatgaagaataaagtctggaatgtttctctcaagacctttgtcttaaaagggatgctgaagaagttcaaagaggaccttcggggagagctggagaaagaggagaaagtggagctcaccttggatcccgacacggccaacccgcgcctcatcctctctctggatcttaagggcgtgcgcctcggcgagcgggcccaggacctgcccaaccacccctgccgcttcgacaccaacacccgcgtcctggcgtcctgcggcttctcctcgggccggcatcactgggaggtggaggtgggctctaaggacggctgggcctttggcgtggcccgcgagagcgtgcgccgaaagggcctgacgcccttcactcccgaggagggcgtctgggccctgcagctcaacggcggccagtactgggccgtgaccagccccgagcggtcgcccctcagctgcgggcacctgtcgcgcgtgcgggtggccctggacctggaggtgggagccgtgtccttctacgctgtggaggacatgcgccacctctacaccttccgcgtcaacttccaggagcgcgtgttcccgcttttctctgtttgctccacgggcacctacttgcgaatctggccttgaggggcactgctggggagctcctgtctctgggctgccggtgggaggggatgtcgcctccccagagatgcctggtccgtcttgggtctgccctccgtgctcctgacccctgctgcccaagagagcctgctacagacacaaccccgaggcaggagagtgactgtggccaaccgagcaggggaacaggggctttggactcctgagggtgttcccttcctgaggtcacatgtggatttggccagagccttcaggaggtggaggccggtgaggtcaggagcccagctctccagggggcttctgccctgactgggaagggtgcctggctccctaaaacaatgtcaaagccagtcctgctgttctctgttgccagggggcaggtctgggcctgggccaaccacgtttgttatcatggctgctgccttctggacagctgccagctctgccttgagaggttgtgggacctctggatccagctgacctgacaggtcatctactcagggaggagccctgtgctcccagctcagaggacagtctgggccagaactggaaggagacatctgtcccgtctttgagtgacaagcccgggacaacagccagtgggcatcacggctctccagcactccttagccggaggatacagagtgatgggtgcatcctgaccaatgcgacaaccaacacgtgctctcacaaacccctgactcccgcactttccagtgccaaagtacaaacgctgcttggataaggagagcaaagcttctggaactttatttactctttctttttaattttcttttaagagactgggtcttgctatgttgcccaggctggtcttgaactcctggcctcaagtgatcctccagtttccatctccctaagagctgggattacaggtgtgagccgctgtacccgaactttttttgtttttgcttctggaactttgaaacacaaaacacaagttggcacttacaattttaaagatgcagccagctctaaacaacacacagagcacaaatatgctcctgacggactcaggaaaatgccaacagcagagcaccctggtgccaaggccttctcagcccatgccctggagggcattcccctggccagcctcagccccttgtctacttgttctccagcttctgggtagctgggcttctggaagggtggcagtgggctactccctgctcagcgctcccctgggaagggggtgaggagatgaaaatgaaactatgagctgtctttgga

SEQ ID NO: 119 - DNA, 4753 bp, Homo sapiens
ttttatgggcggatggaaggggccggggcagcgtcggggaaaggaagggccggaggcgcggcggcgggcggccgagaggggcggcggcggcggcggcggcggggttcccgcgccgcggagcccggcccgagagccgcgtccacgttcctgcctcctgctcccgccgccctggggcgccgccatgacgcccgatctgctcaacttcaagaagggatggatgtcgatcttggacgagcctggagagcctccctccccctcgctcaccaccacctctacttcgcagtggaagaaacattggtttgtgctgacagattcaagtctcaaatattacagagactccactgctgaggaggcagatgagctggatggtgagatcgacctgcgttcctgcacggatgtcactgagtacgcggtgcagcgcaactatggcttccagatccacaccaaggatgctgtctataccttgtcggccatgacctcaggcatccggcggaactggatcgaggctctgagaaagaccgtacgtccaacttcagccccagatgtcaccaagctctcggactctaacaaggagaacgcgctgcacagctacagcacccagaagggccccctgaaggcaggggagcagcgggcgggctctgaggtcatcagccggggtggccctcggaaggcggacgggcagcgtcaggccttggactacgtggagctctcgccgctgacccaggcttccccgcagcgggcccgcaccccagcccgcactcctgaccgcctggccaagcaggaggagctggagcgggacctggcccagcgctccgaggagcggcgcaagtggtttgaggccacagacagcaggaccccagaggtgcctgctggtgaggggccgcgccggggcctgggtgcccccctgactgaggaccagcaaaaccggcttagtgaggagatcgagaagaagtggcaggagctggagaagctgcccctgcgggagaataagcgggtgcccctcactgccctgctcaaccaaagccgcggagagcgccgagggcccccaagtgacggccacgaggcactggagaaggaggttcaggctcttcgggcccagctggaggcgtggcgtctccaaggggaggctcctcagagtgcactgagatcccaggaggatggccacatccccccgggctacatctcacaggaggcatgtgagcgcagcctggcagagatggagtcctcgcaccagcaggtgatggaggagctgcagcggcaccacgagcgggagctgcagcgcctgcagcaggagaaggagtggctcctggctgaggagacggcagccacggcctcagccattgaagccatgaagaaggcctaccaggaagagctgagccgagagctgagcaaaacacggagtctccagcagggcccggatggcctccggaagcagcaccagtcagatgtggaggcactgaagcgagagctgcaggtgctatcggagcagtactcgcagaagtgcctggagattggggcactcatgcggcaggctgaggagcgcgagcacacgctgcgccgctgccagcaggagggccaggagctgctgcgccacaaccaggagctgcatggccgcctgtcagaggagatagaccagctgcgcggcttcattgcctcgcagggcatgggcaatggctgcgggcgcagcaacgagcggagttcctgcgagctagaggtgctgcttcgcgtaaaagaaaacgaactccagtacctaaagaaggaggtgcagtgcctccgggacgagctccagatgatgcagaaggacaagcgcttcacctcgggaaagtaccaggacgtctatgtggagctgagccacatcaagacacggtctgagcgggagatcgagcagctgaaggagcacctgcgtcttgccatggccgccctccaggagaaggagtcgatgcgcaacagcctggctgagtagaggtcccgcccagctgcagaccctccaggctggaggaccagccgccctccttccctcctggatggaagtaaaaagccaagctttctccccaccctctgtgggccacacgtgcacttgcacccaccacacacacacacacacacacacacacacacacagacacacagacacatacgcacacacgtgcacacatgtacacacggatacacacacacacacacacactgcatatctgagcgcgcccctcgcactgggtctcaccttgcaccttcttcaggattttatatgtgaagagatttttatatagatttttttcctttttttccaaaacactttatactttaaaaaaaaaaaaaaaaagcaattcctggtggctgtgtgcctccaaccctggtccccctctgtctccagccaccctctgcttgggcttctgagctggtggccctggcccagaggtctggcggaggcccaggcagcagccatggcggggtgtctctacaggggagaggcgggagcctgccaccctcttcctgccctacctcctactaacacttcctgccccatttggacccgtaccatggggctcaggacagagggagctagcagctggcctccatggccccacagcctccttcgaggctgtgctgggtgcagaaccgccagagccacccaaaaggtgtttctcttctgctccctgaacctcttaacttaataaaacgttccagcagctctggtgtcctagatggctggcagaacaggaatggagattggggtttcttgaagtggcttccccactcacaccctacccacaccccacccttcctaaagcagcggcctctaggcttctgagggtggggctgaaaatccaaggtctcccttagtacagactgtgacgcccccagtgtggcttgcaggctagtggcagcggaagcatgtgggaaatagcaagtccagtcccaccccaacctactgaaccagcgtctgcattttaacagggtgccccagtgattcacgtgaccttcaaagtctgaggagccctggagtagggcccagggcccaggcctgagagagaggcctggggctaagactagccctgaccatgaccttgggcaagtcacacccctcactgagcctcagtttgcttctccatcaaatgggtgtttttctttcagtcccagtcctctcctgaggcttttcccagaggtcatgcccagccctgggcaggggtgagggcagggttgtggctgccaggcacaggtccagcgggctgggagtcctcaccatggctggctgtgctgattatggttgcatggggctgggaagaggtcccatttctgagccacagaaacaggccacatccagtaggggtcctggaaggctgtgagaacccagaggagaccctgacccagcctgcaggtagaagactgcctttggaggcagctttgaaagatgactcttccagatggaagaatcaggaagggccttcccacgtggaggcaccagcaggagcaaacgtccctggtgtgttcaggcaaagagccacaggagagtgacctcgtggagtgggaagagattgtttcccattcccttgccagggattggttgaggaatggacaaggcttgcagttcacgcaagccagtgaaatgcgaggggaagtcttgggagtggggtggaggaggtcatctgggaagggtgtccttggtcttaaaaagaggcacaagaggccgggcgcggtggctcttgcctattatcctagcactttgggaggccaaggcagggggatcacttgaggtcaggagttcgagaccagcctggccaacatggtgaaaccccgtctctactaaaaatacaaaaaattagccagacgtggtgccaagcacctgtaatcccagctactcaggaggctgaggcaggagaatcacttgaacccaggaggcagaagttgcagtgagccaagatcgcgccactgcactccagcctgtgtgacaagggcgaaactccatctcaaaaaaaaagggggagggtggcgcaaggagaggacacctctctcctggccctgtcgccatcttccctcatcaatagctaaaaatggcaaagaagaaagagccaggaccccgtgccatcaaatcctccggccttgtgctgccctgtctcggcactgcttgccttaggagatcaggagtgttcctagccactgggagatgggatgcctgccactggcagctctgccgtccatcctcaccatcccaccgtccccccaagacagctctccatcccatcctctgcctcccttctagcctcaacctaactcagggctcccccgtctcacacctgggttgcaggaacatcctcttcaccaacccccctcccatccctcctcagggctgcctagggcagctacaaaaaccaggccagcctctgaaaggtgctccacatctcattaaaaaccgtgaaatcgcactgccccactatcagaatagctcagaggagaaggtctgccagtaccaagtgctggtggggatacggagaagagcagctcccaggcgctgctggtgcaaatgtgctttgttgcacccacggcaggaaactgaccagcttctcatcaagttaaatacgcatctaccctatggcctagcatttccactcttgcttacacatccaggagaaatgagtccttacatgcacaaaaggatgagtaccgtaatactcacatcagcaaataaacaatacagctgtgtgtcagtagtagaatgaataaattgtggtcgattcataaaaaaaaaaaaaaa

SEQ ID NO: 120 - DNA, 1116 bp, Homo sapiens
ctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcaggtgcgttgcagcctagacgggtcttactgtgagccgagcagcctctgggacctgtctgcttcccctaccccttgcaaagaagccggagcccagagctcccctgaacagcagctgcagcagccatggccccgccctgggtgcccgccatgggcttcacgctggcgcccagcctggggtgcttcgtgggctcccgctttgtccacggcgagggtctccgctggtacgccggcctgcagaagccctcgtggcacccgccccactgggtgctgggccctgtctggggcacgctctactcagccatggggtacggctcctacctggtctggaaagagctgggaggcttcacagagaaggctgtggttcccctgggcctctacactgggcagctggccctgaactgggcatggccccccatcttctttggtgcccgacaaatgggctgggccttggtggatctcctgctggtcagtggggcggcggcagccactaccgtggcctggtaccaggtgagcccgctggccgcccgcctgctctacccctacctggcctggctggccttcacgaccacactcaactactgcgtatggcgggacaaccatggctggcgtgggggacggcggctgccagagtgagtgcccggcccaccagggactgcagctgcaccagcaggtgccatcacgcttgtgatgtggtggccgtcacgctttcatgaccactgggcctgctagtctgtcagggccttggcccaggggtcagcagagcttcagaggtggccccacctgagcccccacccgggagcagtgtcctgtgctttctgcatgcttagagcatgttcttggaacatggaattttataagctgaataaagtttttgacttcctttaaaaaaaaaaaaaaaaaaaaaaaaaaaaaaaaaaaaaaaaa

SEQ ID NO: 121 - DNA, 1809 bp, Homo sapiens
attccagctgcgactgctgagggagaaaatgatgcccaggttgggctccccggcccaccggccgaggagaggcctgcgctgcacacgcgcagaccgagcatccgcgtcaagaggcgaagagagcgcgcgctccccacgtcctgcgctcctggctgccgggcattcgtctcagccgtgactctcgccaggccggggctggcgcgcccacgtctgaagagcgatgccccgggagatcatcaccctgcagctgggccagtgcggcaaccagattgggttcgagttctggaaacagctgtgcgccgagcatggtatcagccccgagggcatcgtggaggaattcgccaccgagggcactgaccgcaaggacgtctttttctaccaggcagacgatgagcactacatcccccgggccgtgctgctggacttggaaccccgggtgatccactccatcctcaactccccctatgccaagctctacaacccagagaacatctacctgtcggaacatggaggaggagctggcaacaactgggccagcggattctcccagggtgagaaaattcatgaagacatctttgacatcatagaccgagaagcagatggaagtgacagtttggagctccagaacagctccagagtgataaagggcttcgtgctgtgtcactccatcgctgggggtacgggttctggcctgggctcctacctcctggagcgactgaatgacaggtaccccaagaagctagtgcagacttattcagtgtttccctaccaggacgagatgagcgacgtagtggttcagccctacaattcactcctgacactcaagaggctgacgcagaacgcagattgtgtggtggtgctggacaacacagccctgaaccggattgccacagaccgcctgcacatccagaacccgtccttctcccagatcaaccagctggtgtccaccatcatgtcggccagcaccaccaccctgcgctaccccggctacatgaacaatgacctcatcggcctcatcgcctcgctcattcccaccccacggctccacttcctcatgaccggctacaccccgctcactacagaccagtcagtggccagcgtgaggaagaccacggtcctggatgtcatgaggcggctgctgcagcccaagaacgtgatggtgtccacaggccgagaccgccagaccaaccactgctacatcgccatcctcaacatcatccagggagaggtggaccccacccaggtccacaagagcctgcagaggatccgggaacggaagttggccaacttcatcccgtggggccccgccagcatccaggtggccctgtcgaggaagtctccctacctgccctcggcccaccgggtcagcgggctcatgatggccaaccacaccagcatctcctcgctctttgaaagttcctgccagcagtttgacaagctgcggaagcgggatgccttcctcgagcagttccgtaaggaggacatgttcaaggacaactttgatgagatggacaggtctagggaggttgttcaggagctcattgatgagtaccatgcggccacccagccagactacatttcctggggcacccaggagcagtgatttccctccccactactccttctccttctagatggtaaccacagcctcgaccatgcctgctccctctgacccagcttcacctcatggacaacccttcttggttcatctccagcccgtgagctggtcctgcttcctcccttccatgccctaacttttaatatgcttgttcagctctaataaagtaataaagcttggttgtcagtata

SEQ ID NO: 122 - DNA, 1915 bp, Homo sapiens
attttcttccggtggctggtctccggcggccccgtccccgactgggccccgtgcccccccgcccccgcggccccccgccgccgggccagccgccaccatgaagaaattctttcaggagttcaaggccgacatcaagttcaagagcgcgggacccggtcagaagctcaaagagtccgtgggggaaaaggcccacaaagagaagcccaaccagccagcccccaggccgccccgccagggacccaccaatgaggcacagatggcagccgctgccgccctagcccggctggagcagaagcagtcccgggcctggggccccacatcgcaggacaccatccgaaaccaggtgagaaaggaacttcaagccgaagccaccgtcagcgggagccccgaggccccagggaccaacgtggtatctgagcccagagaggaaggctctgcccacctggctgtgcctggcgtgtacttcacctgtccgctcactggggccaccctgaggaaggaccagcgggacgcctgcatcaaggaggccattctcttgcacttctccaccgacccagtggccgcctccatcatgaagatctacacgttcaacaaagaccaggaccgggtgaagctgggtgtggacaccattgccaagtacctggacaacatccacctgcaccccgaggaggagaagtaccggaagatcaagctgcagaacaaggtgtttcaggagcgcattaactgcctggaagggacccacgagttttttgaggccattgggttccagaaggtgttgcttcccgcccaggatcaggaggaccccgaggagttctacgtgctgagcgagaccaccttggcccagccccagagcctggagaggcacaaggaacagctgctggctgcggagcccgtgcgcgccaagctggacaggcagcgccgcgtcttccagccctcgcccctggcctcgcagttcgaactgcctggggacttcttcaacctcacagcagaggagatcaagcgggagcagaggctcaggtccgaggcggtggagcggctgagcgtgctgcggaccaaggccatgcgggagaaggaggagcagcgggggctgcgcaagtacaactacacgctgctgcgcgtgcgcctccccgatggctgcctcctgcagggcactttctacgctcgggagcggctgggggcggtgtacgggttcgtccgggaggccctgcagagcgactggctgccttttgagctgctggcctcgggagggcagaagctgtccgaggacgagaacctggccttgaacgagtgcgggctggtgccctctgccctcctgaccttctcgtgggacatggctgtgctggaggacatcaaggccgcgggggccgagccggactccatcctgaaacccgagctcctgtcagccatcgagaagctcttgtgaaataaaagcagggttggcctcagccctgtgggtctgtctcatgctctccctgttcctctccccgccaccccagggcctccaagccacctctggaaatacttggctctgccccatgggcacgggaggggcgccagccgtggagctgtggaattgggccccgtggcagagcccccatcccttgggggctgtggggatgcgcccaagcccccgagggagaggcctggggacaccaacaaatctaagccctccctagctgcttggtaactgtgtcatgaagctgccggacagacacacgtggcatctccctgggcaggagagcaggcctgcagcatgggtcctgttcccgtgtgccgtgggtggcagtggctgcacctggcactagggctgctctgtggatgtgggtgacaacggcaggaggggatgctggccttcctgcacatagacctgcagttagtaaatcataagcccaaataaacaggttgtttgaatata

SEQ ID NO: 123 - DNA, 2242 bp, Homo sapiens
acagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccggagccagccccgaacccctgaacctccagccaggggcgccccgggagcagccagcccgtgggcgagccgcccgcccgccgagcagccatgagcgagacggtcatctgttccagccgggccactgtgatgctttatgatgatggcaacaagcgatggctccctgctggcacgggtccccaggccttcagccgcgtccagatctaccacaaccccacggccaattcctttcgcgtcgtgggccggaagatgcagcccgaccagcaggtggtcatcaactgtgccatcgtccggggtgtcaagtataaccaggccacccccaacttccatcagtggcgcgacgctcgccaggtctggggcctcaacttcggcagcaaggaggatgcggcccagtttgccgccggcatggccagtgccctagaggcgttggaaggaggtgggccccctccacccccagcacttcccacctggtcggtcccgaacggcccctccccggaggaggtggagcagcagaaaaggcagcagcccggcccgtcggagcacatagagcgccgggtctccaatgcaggaggcccacctgctccccccgctgggggtccacccccaccaccaggacctccccctcctccaggtccccccccacccccaggtttgcccccttcgggggtcccagctgcagcgcacggagcagggggaggaccaccccctgcaccccctctcccggcagcacagggccctggtggtgggggagctggggccccaggcctggccgcagctattgctggagccaaactcaggaaagtcagcaagcaggaggaggcctcaggggggcccacagcccccaaagctgagagtggtcgaagcggaggtgggggactcatggaagagatgaacgccatgctggcccggagaaggaaagccacgcaagttggggagaaaacccccaaggatgaatctgccaatcaggaggagccagaggccagagtcccggcccagagtgaatctgtgcggagaccctgggagaagaacagcacaaccttgccaaggatgaagtcgtcttcttcggtgaccacttccgagacccaaccctgcacgcccagctccagtgattactcggacctacagagggtgaaacaggagcttctggaagaggtgaagaaggaattgcagaaagtgaaagaggaaatcattgaagccttcgtccaggagctgaggaagcggggttctccctgaccacagggacccagaagacccgcttctcctttccgcacacccggcctgtcaccctgctttccctgcctctacttgacttggaattggctgaagactacacaggaatgcatcgttcccactccccatcccacttggaaaactccaagggggtgtggcttccctgctcacacccacactggctgctgattggctggggaggcccccgcccttttctccctttggtccttcccctctgccatccccttggggccggtccctctgctggggatgcaccaatgaaccccacaggaagggggaaggaaggagggaatttcacattcccttgttctagattcactttaacgcttaatgccttcaaagttttggtttttttaagaaaaaaaaatatatatatatttgggttttgggggaaaagggaaatttttttttctctttggttttgataaaatgggatgtgggagtttttaaatgctatagccctgggcttgccccatttggggcagctatttaaggggaggggatgtctcaccgggctgggggtgagatatccccccaccccagggactccccttccctctggctccttccccttttctatgaggaaataagatgctgtaactttttggaacctcagttttttgattttttatttgggtaggttttggggtccaggccattttttttaccccttggaggaaataagatgagggagaaaggagaaggggaggaaacttctcccctcccaccttcacctttagcttcttgaaaatgggcccctgcagaataaatctgccagtttttataaa

SEQ ID NO: 124 - DNA, 1977 bp, Homo sapiens
aaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcacaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctga

SEQ ID NO: 125 - DNA, 3948 bp, Homo sapiens
gagtcacctggggcggccgacaagtgcggacacattggccgccgcggcgctcggcgaggcgctcacggcctcaggcggctgcgcctagtgcaggctgcacccgcccgccagccgcgcccgggcccccggcccgcgcttgcaggggtccacggtcgctcaaccgggcttcgaggtcgcggcccccagcctgggtcaattccccgggctcacgcggcggtggcggcggcggcatcccgggctcaccatggtggcagcgcgcgccgagtgcccgcgcgtcgccggccgcccgagccgcagcgcgggctgagcgcagtctgcccgcagccccctggcccctgcccggccctgccgggcccgcgcgtcccctccggccgccgctgtctatggcgcagcccccctccctggatcatgcacagaaactttcgcaagtggattttctacgtgtttctctgctttggcgtcctgtacgtgaagctcggagcactgtcatccgtggtggccctgggagccaacatcatctgcaacaagattcctggcctagccccgcggcagcgtgccatctgccagagtcggcccgatgccatcattgtgattggggagggggcgcagatgggcatcaacgagtgccagtaccagttccgcttcggacgctggaactgctctgccctcggcgagaagaccgtcttcgggcaagagctccgagtagggagccgtgaggctgccttcacgtacgccatcaccgcggctggcgtggcgcacgccgtcaccgctgcctgcagccaagggaacctgagcaactgcggctgcgaccgcgagaagcagggctactacaaccaagccgagggctggaagtggggcggctgctcggccgacgtgcgttacggcatcgacttctcccggcgcttcgtggacgctcgggagatcaagaagaacgcgcggcgcctcatgaacctgcataacaatgaggccggcaggaaggttctagaggaccggatgcagctggagtgcaagtgccacggcgtgtctggctcctgcaccaccaaaacctgctggaccacgctgcccaagttccgagaggtgggccacctgctgaaggagaagtacaacgcggccgtgcaggtggaggtggtgcgggccagccgtctgcggcagcccaccttcctgcgcatcaaacagctgcgcagctatcagaagcccatggagacagacctggtgtacattgagaagtcgcccaactactgcgaggaggacgcggccacgggcagcgtgggcacgcagggccgtctctgcaaccgcacgtcgcccggcgcggacggctgtgacaccatgtgctgcggccgaggctacaacacccaccagtacaccaaggtgtggcagtgcaactgcaaattccactggtgctgcttcgtcaagtgcaacacctgcagcgagcgcaccgaggtcttcacctgcaagtgaggccaggcccggaggcggccgcgggcaccctggaacccggcggcattttgcacatccactcctcaccttccctgccttggtgctgccagcagcagacatagacgggtgcagaagcggggagctccaggtgcaggagggcaccggccggggcccacgccctctgcccgcctccctggggctccttcctgccacctcctcccatcacctcctgcggcagaacagcacccgtgacccacccagagagcaaggccaggggtcttggtgctccccgacggggcccggcaagttctctttcttctctctgggaaaatgaacgtccaggacacacctgtatcccagagagcaaagtgatgaggagactgagcgtccccagccccacctggcggcatggacacagaaaagctacgccggctggcctctccagaccagttcccaggctgggtctgccgctgggccctggggcggtggggacagatgttgacacaaattatttatgttttcttagtatcagaagaggattctcggcactaacacatagccagtcctaactccgtactctgtgtcagcccatcccctagacaccctctgtttcctttcccggccccacctggccggccctctgcccctgcagagctgaggcagcctggggttgatggggaccacgcggtgcctgcaggtcctagaagtgagctgggcaggggctcttcagaccacacagccctgaccgggccttggaggagagccatggacaggctcctccatgccgtctttccttcttttgaaaatcctatcaatggctgggcgcggtggctcacacctgtaatcccagcactttgggagaccgaggcaggtggatcacctgaggtcaggagttcgagaccagcctggccaacgtggtgaaaccctgtctctactaaaaatacaaaaattagctgggcgtggtggcgtgcacctgtaatcccagctactcaggaggctgagacaggacacttgcttgaacccgggaggtggaggttgcaatgagccaagattgtgccactgtattccaacttgggtgacagagcacgactctgtctcaaaaaaagaaaagaaaataatatcaagcaaatcaaaatatcacccacgtcaggttccaggagtccttcgttccctccctcatcctgtcaccctcccggcctggcacctccagtttacagagacccccttccccctggagccagcctgacccctgggacagtgctgccgcgggggtcaggcaggtggtgagtggtcagggatgtttgtcccacttgacagatgggaactctgaggcccagagtggcacaaggacctaccagagaccctgcagctgtgactggaggcttccacctttctcctgcccagcctggggctctggacctgggagaacacatcaggatgcccggggtggcagtaggtagctcccatgccttgaggcacttggctgctccctccaccccctgacagcctcattggggcctgcactcccctcggtgcctttgaggcttcgcctagccctgtcctggtccttttaccctgaccccagtgctgagaaaatctggatccagagctggacatgtcctttctggatgctcccacccctgtctctgaggagcatgagtgacagagggaggaacttgtccgaggccagagaggatggtctgcagctggctcctggtgcacccccactgcccacggcctggcccccatttagggtgtgttctcttggaagcccgtaggaatgtgttcttgagcagccgacaagccaagggcctgggctcagcctggggcaagtgggtccctcctgggctctggccctgtggtccagcccatgtgcctctaaccatgcctggacgctctgagtctccgggccaccgtgaatgccccaccctcagcctggccccatccccttaccttccccaagtcccagaacacacctgagtccataggcccggcagcctctgcaaggaacctggttaacttatgttgttatatagcgtcgaaatgtctatagtgtctttaaattattgtgacctacactgggtaccggagagggggatggctgcggcccccatccctcatcccccatcccatcccatccctcatctcatccctcatcccatcccccatcccatccctgaccccatcccccatcccatccctcatccctattccccatacccaccccccatcccatcccccatctcccgaaccaggctcctcctgcttcaacagacccttggggcccctgatgccaccgagacactcgcactgtcccttggctgccgggcaccccactgagcccctgcccaccccaaagtctgccagcaacaggccctttgcctgggtgagacgggggtcagggtggcccagatgggggtgatggcgaccaaggtgctgcgtccccacccttctgacggcagcctcccctggaggggagtgctcggcccaataaaagctggaatcggaaaa

SEQ ID NO: 126 - DNA, 6437 bp, Homo sapiens
ggagaaaccaggaagggagtcgcgagcatcatacggggctttggctgtactgtacagttactgtaggggcagtgacgccgccgccgccgcgcgagggagcgaccagggcagcgcgacgcgggcagagcgagcgccgcggaccccggaggcgagcggccgagggagcccagtcccaacttcgggccccggccccgcgcgccccggcccggccccgcgaggtctcggcgcggaagatggccggcggcgtggacggccccatcgggatcccgttccccgaccacagcagcgacatcctgagtgggctgaacgagcagcggacgcagggcctgctgtgcgacgtggtgatcctggtggagggccgcgagttccccacgcaccgctcggtgctggccgcctgcagccagtacttcaagaagctgttcacgtcgggcgccgtggtggaccagcagaacgtgtacgagatcgacttcgtcagcgccgaggcgctcaccgcgctcatggacttcgcctacacggccacgctcaccgtcagcacagccaacgtgggtgacatcctcagcgccgcccgcctgctggagatccccgccgtgagccacgtgtgcgccgacctcctggaccggcagatcctggcggccgacgcgggcgccgacgccgggcagctggaccttgtagatcaaattgatcagcgcaacctcctccgcgccaaggagtacctcgagttcttccagagcaaccccatgaacagcctgccccccgcggccgccgccgccgctgccagcttcccgtggtccgcctttggggcgtccgatgatgacctggatgccaccaaggaggccgtggccgccgctgtggccgccgtggccgcgggcgactgcaacggcttagacttctatgggccgggccccccggccgagcggcccccgacgggggacggggacgagggcgacagcaacccgggtctgtggccagagcgggatgaggacgcccccaccgggggtctctttccgccgccggtggccccgccggccgccacgcagaacggccactacggccgcggcggagaggaggaggccgcctcgctgtcggaggcggcccccgagccgggcgactctccgggcttcctgtcgggagcggccgagggcgaggacggggacgggcccgacgtggacgggctggcggccagcacgctgctgcagcagatgatgtcatcggtgggccgggcgggggccgcggcgggggacagcgacgaggagtcgcgggccgacgacaagggcgtcatggactactacctgaagtacttcagcggcgcccacgacggcgacgtctacccggcctggtcgcagaaggtggagaagaagatccgagccaaggccttccagaagtgccccatctgcgagaaggtcatccagggcgccggcaagctgccgcgacacatccgcacccacacgggcgagaagccctacgagtgcaacatctgcaaggtccgcttcaccaggcaggacaagctgaaggtgcacatgcggaagcacacgggcgagaagccgtacctgtgccagcagtgcggcgccgcctttgcccacaactacgacctgaagaaccacatgcgcgtgcacacgggcctgcgcccctaccagtgcgacagctgctgcaagaccttcgtccgctccgaccacctgcacagacacctcaagaaagacggctgcaacggcgtcccctcgcgccgcggccgcaagccccgcgtccggggcggggcgcccgaccccagcccgggggccaccgcgacccccggcgcccccgcccagcccagctcccccgacgcccggcgcaacggccaggagaagcactttaaggacgaggacgaggacgaggacgtggccagccccgacggcttgggccggttgaatgtagcgggcgccggtggaggaggtgacagcggaggtggccccggggccgccaccgacggtaacttcacagccggactcgcctaaaaaccaaaaagagaaaacagaaacccgagaaagagagagacagagagagagaaaaaaaatcacccaccacccccccaaaaacacaaaaaaagaaaatctatctatatacagatatctatatctatatatatatatacagatatatatatatgacgcgtcacagaatctagggtagcgctttctcagatttccctcctttctgacgtttttctccctccgcaggggccccggccctccctggctccccttccccccaccaccccatcgctgggtttcggggcttggtttggggttttttgtaggacacaaggaatccgagaccccgcacagccccctgggcacccggcatggggcctggggcccgatccgaggccctgggctggggggagggtagacgtgggggcgctggggggggactggggtgggcttttaatttcctcccctcgctggtttctatgagtctttcagacaagaccttaaatgatttctgtctgctctgagcggacgttaaaatgggcccccgtcccccgacccgcaccctccttcctcagggcacttactaagggaggggtctccctctccatctccccagtggcctccccgcctccaaccctgcctgcggcctccccccgtcgcccaccccacgtctcctggccactgagacacaaacctatttatttctaggcctggagaaaggagatcggactggggttcccggtggggcgccaggatggctcctgggggtgctcctgccgccttccttcacggcacttacaaccggcgggacccccagggaccacccctcagggcgcccccccacccccgcccggtccacctagacccccacgtttggagattcaaaacttctgtcttcgtcctctcccccgagccccctctcccaaatttttaaagcactttttagatttttttttctctttcctccttaaaaacaaaatttatatatagatatatatatatatataaataatatacttttcctcagaggagcaggcaacagtgtgggataaacagagtcacgatcagaggaaccccagggtctggtgatggcagggatggggggagagagagaaaatccacaaattccaatgtcacaaaagcaataaaacaaactagaaaaaaaaaaggttttacaaaatgaaaggaaggaaaaaaaaaaaggcaaccaaccacattagaagtcttggcactttgtaacggaacgggtactacactttatcttaattcttaatttaaaaacatgtttacaagttacaaccaacttctatgaaaagttgaaaagacaaaaaaaaaaaaaaaaagcgagcgagagagagagcgagagagagagcgagagcagaagaaattcctaaaagtcgatttatttttgtacaaaataataaaaaaaaaaacccaccacaaacgtagaatccacttctgttccccaaaaagcgagaaggggggttcaggaggaagccatcgcaggggacctgggagacgccccgaggtgtttgtgcttcacccccagacgtcagcctcgaaggcaggactgtggggtgttcgtgctgtgttccccccgctccccctttctgtccccttttttggttctgacgtgaagaggtcttagcgcccgcttctgtccacggggtctctccttcctcctccctagctcagggatgggccttccagccggagcaccccgatccccatccggcaccccccaatcccccaacacgcctgtccctcccgcatggccaccaaggagctggaccttggatgcgcctaccctgctgaggtgggtgacaggggccccccacctccagggccttagaaccaccgcccctctccccaccccaggcacccctctttttactcaaaggcactgactgtaatccagggggactgggacctgcctccccccaacctctggctcccacaaggcccggtgttgaccgagccacaggccacggacaggggccggggttggggagactatgtcgccagatgccaggacgccctcaccccgtttgcatatgcaatgctagcatgggaccccgaaaatagacgctctgctgcactgagacttcttgtcaatgcccaaccggcgggggggtgtctccctgcccccgacccccccatacccccttctctgtgacacacacatcttctcgtctctttttctttcattgttaaagggaagctttttaagaaggcaattttcatattgtttctacaggatggttttggttcccttcccttcccacccccccttaagcctgtcagccccctccaaatgtctcaggatcccccctctcccctggggctgggtgacagcaccccggctgcgttcacaccccagtgtcacagggcgagctgttctggagagaaaaccatctgtcgtggctgagcggggagcttgaacacccaggccagggacacccctccccagctcccagagaggccccctgaggggtgagccctctttccaccttcccctatccatgcaccccctcgcaataaaaccaactctaaaatcacagctgtcgtcctagccagtgggggcgaccggacttggggggtggagccctctgggacttccgtaggaacaagggctgcggcccaccgcgacacttacacagacctcggggattgcactaaaccctcgttcctagctccgcactcagcttcgcctgtcctgcccgcccactttgccttaactacccgcccgtcctgggggccacagcctctgcatgggcccagagccgggacccccccagcccagccccgccctccccagactccgcgcaatcacatactgtatatagacgtgaatcgattttatttttattctttaaattaaggtcgtgataaagtgttgccaaagatacctgctgaattctcgcgtttcaggaaacaaacaaacaaaaaaaaatgatatttgaggagggtcgtgttgactccatatgaaaggacacagctcaaagcttttttgtttggttgtttggggttttttgtgttttctttttttggggtgttttttttttaactgcctggtacaaaaaaaaaaagagaaaaaaaaaaaagaaaaacaatgcgaaattgttatttccattctcatggtgaagttgcgtggacgcgtgtgtgcgtgtgtgcaagagagcgggagtgaggtccaggctggggttggggggcttcaggcgggggcgcccgggggccggggaggtggccgggccggagcccccgtctgcagtgccccccagcctgccgggcccaggagagagagagaagcatctttgctactagctgttgctgctacctgcctctgccccccgacgccccccgccttttgagattaaggaaaaaaaaaaaaagtcaaaaaagtttttaaaaatgaaaaaaaaaaattataaaccagtgaatgtaaaatgccggagcaggcccggcctggcatgggtgtggacctgcagccaggcaggctcgagcgggcgataccaaagtctgcccccccaccattgtggccatgcagtcctgtcactgtctttttgcttccttccgaggggggtcccccagcctcttccagggtcttcccctggaagtgggcggctgcagggaaggtgggggacaggggtctttgcacgattcagaccccggggccgtggcaggagcggtcacctcacaggtggtgacactgaggcaggggcctcggggtgccccctcccgcccggcaaccagaatggttggaggcaagacagagagaatgaaaggaaaaacagaagaaaaaaaaatattaaaaaccaacaaaaaaagcaaaaatcctattttttgagaaagaaagatatttatatttgcagttttattttaaaaagttatttaagttgaagcagccttcctggaggtgggggggggggggtggtgggtggctggcgcaggacgggtcaggggcctggaggctgggggtgccccaggagctacaacctcagagttaagactagctcgcattaaatacatagatttacggggggggggggggggggccgggcccagggggtggagggggccagggagacccccatccctcgccggggctgcctggaggctgtggaccaggatccgatgcccaggtcccgccccccaccccaccccaggcccagaatcgaggtgccttggactttggaggggccaggcctggtgaatggggggcggggcggcgccctcagggtacagagcacagacagatagacattccagagactgtattgagagtctttataaagtgtgggagatttaaaaaaaaaaaaaactgataaaaatgcactttttgggagtggggagggagaagctttaaaagtaataaaaaacaaacaaaaacacaaaagatgaaaaaacaaaaaaattcatttttcttgtacataaaaaaaaaaaaagaaccactaaacgcagcctgttacgacc

SEQ ID NO: 127 - DNA, 2335 bp, Homo sapiens
agaacggcccccgggacagagcgacgcggaaccccgggcgcctgggtccccagcatgatcctcggcagcctgagccgggcagggcccctgcctctgctacggcagcccccgatcatgcagcccccactggacctcaagcagatcctgcccttcccactcgagccagcccctacccttggcctcttcagcaactacagcaccatggaccctgtgcagaaggctgtgctctcccacacttttgggggacccttgctcaagaccaagcggcccgtcatttcctgtaatatctgtcaaatccgcttcaattctcagagccaggctgaggcgcactacaaaggtaatcgccacgcccgacgagtcaaaggcattgaggctgccaagaccagaggcagggagcctggcgtccgagaacctggagacccagctcccccaggcagcaccccaacaaatggggatggtgtagcaccccgtccagtttccatggagaatggactggggccagccccaggatccccagagaaacagcctggctccccatcccctcccagcattccggagactggtcagggtgtaaccaagggtgaaggggggactccagccccggcttccttgcctgggggtagcaaggaagaggaggagaaagccaagcggctgctctactgtgctctgtgcaaggtggctgtgaactccctgtcccagcttgaggcacataacaaaggtactaagcacaagacaattctggaggcccgaagtgggctcgggcccatcaaagcttaccctcggctggggcctcccaccccgggggaaccagaggctcctgcccaggaccgaactttccactgtgagatctgcaatgtcaaggtcaactcggaggtccaactgaaacagcacatctccagccggcggcaccgagacggcgtggccgggaagcccaacccactactgagccgtcacaagaagtctaggggcgccggggagctggcgggcacgctgactttctccaaggagctgcccaagtccctggcgggcggcctgctccccagccccctggcggtggctgcagtgatggcagcggcagcaggctcgccgctgtccctgcgcccggctccagccgcacctcttctccagggaccgccgatcactcaccctctgcttcacccggcccccggacccatccgaactgcgcacggacccatcctcttctccccgtactgacctcaaccctgaacccctcccattcaactccccacctccagccgggacccaggcgtccgggctcccagcccgcccctcctcccggcactccctaaatgatctctccttccccccccccaccccgagatacggggttccaggaaaggggaggggtagcgggggaggggggcttcagaagggggggaacaccccagatctcagggaaccccgccccctgcctttccctctcccctagaaaagggggggccgtctcacccccgagcccccttggagacaccccccctcccaaaagccatgtccatccagcccttccccccaaacctagcacaaaacggggttcacaagccatggtcggggtccgggggggacagaaatggattttcttggcaataagcggactctgggactccggctccctaccccaaactgaagcgcttccgtgaacacccccgtcctccgtagggggaggggagcaggcgggatcctgggtccctcataagcactttggttttaccgcctgcaacctcactgtgcccgccccgcaccatgccctagccccaggtctagccgggcccattgcagggggcagcacttgggggcatctccggcacttgggtgggaccaaggagatgccaccatagacctttccctcgccttcttcctccctagtccgggttccattcttttcaccagcacccatcgcccaaggggtaccgaggggggcaaggggtgtccagtccaagcccacccccgcctcgccttccgcaaaactgtgagcaaaaagcaatagaagcctcgcccccgcccttccccttcgcaggattcgccgagtctgtagcctccccgatccaagttcctagacctcatggctgtcccctcccaccagtcacctccactgcacaactcgggcgggggtgtgacacctctcccccacccccgactccgtggtttccgtatcgtcaacccttcagccgccgacccgggaggggtctggcctacactggtcttccccttcccatcaactctttctgcttgacaatgtagcaacccaggccccccacccacggtcctcccctttttcctctccctgacaataaagtctgaatttgttctgccctcc

SEQ ID NO: 128 - DNA, 2050 bp, Homo sapiens
ctttcctaccctcaacgccgttccggggggccgggcctggcaagtcctcttggaacgcctccctcttgccttccccttttggggacagatcccgaagttcgagcatccctcggataggccgggtgtcaggcctggtctctcaggcccgtccaggcccatcttgacgattccaagaccacccccttgagcaagaatgccatcccctctgggtcccccatgcctgcccgtcatggacccagagaccacccttgaggagcctgagactgcccgcctccgcttccgagggttctgctaccaggaggtggcaggtccccgagaagccctggcccggctgcgtgagctgtgttgccagtggctgcagcctgaggcacactccaaggagcagatgctggagatgctggtgctggagcagttcctgggcacactgcctcccgagatccaggcctgggtgcgcggtcagcggccaggcagtcctgaggaggccgctgccctagtcgaaggactgcagcatgaccctgggcaactgttgggctggatcacagcccatgtcctgaagcaggaggtgctccctgcagcccagaagacagaggaaccacttgggagcccccacccctcagggacagtggagtcccctggggaaggtccccaggacaccagaatagaggggtctgtccagctcagctgcagtgtgaaggaggagcccaatgtcgatggacaggaagtggcaccctccagccctccacttgcagcacagtcccctgaggggaaccatggacaccaagaaccagcctccacatccttccacccacccaggattcaggaggagtgggggctgctggaccggtcacagaaggaactgtactgggatgcgatgctggagaagtacggcacagtggtctccctggggttaccgccccaccagccagaggcacaggcccagtcagagctggggatgctgctcacggggacaggcgtctgcagaagcctgcgctcgggaaatgagagtgagggtccacctggctgcccagaggcccagccgccccagggcccagggccggcagcctgggagggcttgtctggggctgccactcctgcccccactgtgcgcccagggacaccgccagtgcccactcagcccacacctgcagagacgagactggagccggctgccacccccaggaagccctacacgtgcgagcagtgtggccgcggcttcgactggaagtcagtgttcgtcatccaccaccggacacacacgagtgggccaggtgtgcagtccccggggctagccaccggggaaagcacagagaagccaccacaaggggaggtggcctttccgcaccacccccgacgctcactcacaggcccccggagttacccgtgtgaggagtgcgggtgcagcttcagctggaagtcgcagctggtcatccaccgcaagagccacacaggccagcggcgtcacttctgcagtgactgtggccgcgccttcgactggaagtcgcagctggtcatccaccgcaagggccaccggccggaggttccatgagcagccagacagcacagtccctcggggcctcggtgttctcggggcctggatacagcctctggggcaccagcagaagactctggaggcagcaggggatgccagagtgaacaaggggtcccaagccagttccctgcccctggtctggtctcccccaaaagacctgggtgcaaggaaaaggagctgctctctctcttcttgcccctgcctcctagagggaggtctgggttcccttctatggctgaccagtgcctgtggggtgactgccaagcaccaggctccctccctccctgtgacatggcctgggctgacaacactccctctcctgggacctccttgcctcaggtgggtgttcaaaaactgtgccttcccactcgtctgtgcagaggctgggcctgaggtctcagtgtggagagcagcagaagacccaggaaagcacagttggcttccgtttctcctgctccctgtgtgtgttagaattttaacataaattccactttcataata

SEQ ID NO: 129 - DNA, 5645 bp, Homo sapiens
agaagaggaagattagaagattttttttttctttgagagaaagcccagcggagataaacgaatgtcccctcatctccaaagaaaagttcatcggatttttattctagagagctcatcttcaggatgtcagtgaacatttctactgcaggaaaaggtgtggatccaaatacagttgatacttatgacagtggcgatgattgggaaatcggggttggaaatttaataattgatttggacgctgatttggagaaggacagacagaaatttgagatgaataattccaccaccaccactagtagcagcaactccaaggattgtggaggtccggcctccagtggggctggtgctaccgcagccttagctgatggcctaaaatttgcttctgttcaggcctctgctccccaggggaattcacacaaagagaccagcaaatcaaaagtgaaaaggagtaaaacttctaaggatgctaataaatctctgccttctgctgccttgtatgggattcccgagatcagcagcactggcaagaggcaggaagtccaagggcgccctggagaggcaactggcatgaattcagcgctgggtcaaagtgtgagcagcggcggcagcggcaacccaaacagcaatagtaccagcaccagcacctctgccgccaccgcgggggcaggctcctgtgggaaaagcaaagaggagaagccaggtaaaagccagagcagccgaggcgccaagcgggataaggatgcggggaaatccaggaaggacaagcacgacctgcttcagggccaccagaatggcagtggcagccaggccccttccggggggcacctctatggctttggggccaagagcaatggaggtggcgcgagccccttccactgcgggggcactgggagtggcagcgtcgccgctgcaggggaagttagcaaaagtgccccggattcagggctcatgggaaactctatgttggtaaagaaggaagaggaggaggaggagagccacaggcgaatcaagaaactgaaaactgagaaggttgaccccctgtttacagtgccagcgccaccaccgccgatttccagcagtctcacgcctcagattctaccctcctacttttccccatcttcatccaatattgcagcaccggttgaacagcttttggttcggactcgttctgtgggtgtcaatacatgtgaagttggagtagtgacagagccagagtgtcttgggccctgtgaacctgggaccagtgtgaatttggaagggatcgtgtggcatgaaacagaagaaggtgtcctagtggtcaatgtcacgtggaggaacaaaacgtacgtgggaaccctactggactgcaccaagcacgactgggcccctcccaggttttgtgagtcaccgacaagtgacctggagatgagagggggccggggcagagggaagagagcgaggtctgctgctgctgccccgggctccgaggccagcttcacagagtccagagggctgcagaataagaacagagggggggccaatgggaaagggaggcggggcagcctcaatgccagcggacgaaggacacccccaaattgtgctgctgaggatatcaaagccagcccttcctccaccaacaaaaggaaaaacaagcctccaatggagctggacctgaactccagctctgaggacaataagcctggaaagcgtgtccgcacaaattccagaagcactcccactacccctcaagggaaaccagagactacttttttggaccaaggctgctcttctccagtgttaatcgactgtccccacccaaactgcaacaaaaagtacaagcacattaacggcctgaggtaccaccaggctcatgcacacttagacccagaaaacaagctggagttcgagcctgacagtgaggacaagatctcggactgtgaggaaggattgagtaatgtggcacttgaatgcagtgagccaagcacaagtgtatctgcttatgaccagttgaaggcaccggcatcccctggtgctggaaacccacctgggaccccaaagggaaagagagagctgatgagcaatggcccaggttccattattggtgctaaagctgggaagaattctggcaaaaagaagggccttaacaatgaactgaacaaccttccagtaatctccaacatgacggctgcgttagacagttgctcggcagcagacggcagtttggctgctgagatgcctaaactggaagcagaaggattaattgacaagaaaaatttaggagataaagaaaagggcaaaaaagctaccaactgcaaaacggacaaaaacctctctaaactgaaaagtgcccggcccattgcccctgccccagcccccactcccccgcagctaatcgctatacccactgcaacctttacaacgaccaccactgggacaatacccggactgccctccctcacaacaactgttgttcaggctacaccaaagagtcctccgttaaaacccattcaaccaaagcccacaattatgggagagcccatcaccgtgaacccagctctggtgtcactcaaagacaaaaagaaaaaggagaagcgaaagctaaaggacaaagaagggaaagagacgggaagcccaaaaatggatgccaagctggggaaactagaggactccaagggggccagcaaagatttacctgggcattttttaaaggatcatctcaacaagaatgaagggctggcaaatggactgtcggagtctcaggagagccgcatggccagtatcaaagctgaggccgataaggtttacactttcacagacaacgctcccagcccttccatagggagcgcctcgaggctggaatgcagcactttggtgaacgggcaggcaccaatggcacctctgcatgtgttgacccagaatggggcagagagttcagctgcaaagacaagcagcccggcctattcagacatatctgatgctgctgacgatggtggttctgacagcaggtcggagggtatgagatcaaaggccagttccccatcagatattatttctagtaaggacagtgttgtaaaagggcattcttcaactacagcacaatcatctcaactgaaagagtcccattctccctattaccacagctatgatccttattattctccaagttacatgcaccctgggcaggtcggtgcccctgcagctggaaatagtgggagcacgcagggaatgaagatcaagaaggagtctgaggaagatgctgaaaagaaagacaaggcagagcagttagattctaagaaagtggaccacaattctgcatccttacagcctcagcaccagtcggtgatcacacaaagacatcctgccctggctcagtcactttattatggccagtatgcatatgggctctatatggaccagaagtctctgatggccaccagccctgcctatagacagcagtatgagaagtactatgaggaccagaggctggcagagcagaaaatggcccagactgggagaggagactgtgaaaggaaaagtgagctccccttgaaagagctgggcaaggaggaaactaaacagaaaaatatgccatcggccacaatctcaaaagctccctctactccggagcctaacaaaaaccattctaaactagggccatcagtgcctaataaaactgaggagacaggtaaatcgcagcttctctccaatcaccagcagcagcttcaggccgacagcttcaaagctaagcagatggaaaaccaccagcttattaaggaggctgtagaaatgaagtctgtcatggactctatgaagcagacaggtgtagacccaacctcgagatttaaacaagacccagattcaagaacatggcatcattatgtataccagcccaaatatctggatcagcaaaagtcagaagaacttgatagagagaagaaattaaaagaggatagtccgaggaaaactcctaataaagagagtggtgtgcccagccttcctgtatcgttaacaagcattaaagaggagcccaaagaggccaagcatcctgattctcaatcaatggaggagagcaagctgaaaaatgatgatcgaaagactcctgtgaactggaaggactctcggggaacaagagtggctgtctcctcacccatgagtcagcatcagtcatacatacagtacttgcatgcttatccttacccacagatgtacgaccccagccatcctgcataccgggctgtttctcccgtcctaatgcacagttatcctggggcatatctctctccaggatttcattatcctgtttatgggaagatgtcagggagagaagagacagagaaagtcaataccagccctagcgtcaacacgaaaacaaccactgaatctaaagcactggatttgctccagcagcatgctaaccaataccgcagcaagtctcctgctcctgtggaaaaggctacagctgagcgggaacgggaggcagaaagggaaagggatcgccactcccccttcggccagcggcacctgcacacgcaccaccacacccacgttggcatgggttacccgctaatcccgggtcaatatgacccttttcaaggcttgacctctgctgcccttgttgcctctcagcaggtggctgcccaggcatctgcatctggaatgtttcctggacaaagaagagaataacaagattggacatgtacattgtcatgtgactggatcacatggggaagcgctttatacagacatcagttccatggtgttaatttgaaatgccttaatggcaggcaaaaaccagtcatttcatttttgtaaattacagattttatcacagagtaacaaatgttgctgtaattaaacttctgttttatatatatatacgtatacatatctgtatatatacatatatatatatataaatataaatatattctttactttttgtatcagtaaccaggctcgcacacacagggtctgctgccacgtcgcaaaccactcagtaaaggaaattaaaaatgtatttgtcatgttaaaaagtgttagccacaaaaggctacttactttcttttccttttcctttaaaattgtaaataaataatgttatgtatcagtgtgcctgaaccttgcatatccttcacatatttcccataagcccctcagaaaggctaactgtgatgatgacactttggtacaatttagatgtctatttggtggctcctgttaaagacgcaccagtgtaaaatgttcctgtagtcactgtttgtacttgtgtattgtggaaaaagtacttttggaaggcatggggttgccagtaccacaaaaactgtgttgtatataatgtaaagattaaaatggggaaataatgagcatctgtgaataatgaggtgtcattttttgataatcttgaatggcaaataacccaatagcctgcgtaccagagacatctgtgattgttctattacttgaatagttctacagtctttttttttttttaatgtttacaattatccagttttagaagagagagactttaacgccattgcctggttacttgttttatgctgtaatctagtttattttatgtaaaatgtatattgaatgctttccttttttatacctgccttaaataatttggcaatcagaattaaaaagtttttttttttttaaat

SEQ ID NO: 130 - DNA, 4068 bp, Homo sapiens
cttcccgccctggaccctcagcctgacgagaggctgggcagaaactcgcgatccccaggccctgcctgtgcaccagcggctggcgccaggccaatgacagtacgggagagggcaactctcccggccgccacggtgggggccggaacttcctgcactgcagcctcgcaggtcatttcccggcggggaggctgagtccccaggagctggggaccccgagttgggggcggggcggctggggctacgcccgtgaagctgccccgccggctttcccggaccgcgagggggacagtgaggccgggaccccctccgcgcctttgcaccagccgtgaccccttgcaacgggggtacccagcggagctgcgcgctctcggcgcccccggagcctgcgccccgggccccttgcgcattttgcacgggggagactgaggctaggagtgcgaccctcagcccggggtcacacctcgtctggggcacggccaggtgggtggtagcctcagcctgcgagaccccctacccccgccccgtggtttcccgcaccgtggggccctgctctgaccacagactccgatggcagcggcggcgctgcgggaccccgcgcagggctgcgtgacctttgaggacgtgaccatttacttctcccaggaggagtgggtgctcctcgatgaggctcagagactcctgtactgcgatgtgatgctggaaaactttgcacttatagcctcgctgggacttatatctttcaggtcccacatcgtttcccagttggagatggggaaagagccctgggtgcctgacagtgtggatatgacatcagccatggccagaggggcttatggcaggcctggctctgatttttgccatggaacagagggcaaggacttaccttctgagcataacgtttctgtagaaggagtggcacaggacaggagtcccgaggcaactctgtgcccccagaagacctgcccctgtgacatatgtggcctacgtttgaaagacattttgcatttggctgaacaccagacaacacatcccaggcagaaaccatttgtgtgtgaggcatatgtgaaaggctctgagttcagtgcaaaccttccccggaaacaggtgcagcagaacgtacacaaccctatcagaacggaggagggccaggcttcccctgtaaagacctgcagagaccacacatcagatcagctttccacctgcagggagggtgggaaggactttgtggccacagcagggtttctgcagtgtgaggtcactcccagcgatggggagccgcacgaggccaccgaaggtgtggtggattttcacattgcactaaggcataacaagtgctgtgaatctggggatgccttcaataacaaatccactcttgttcagcaccagagaatccacagcagagaaaggccttatgaatgcagcaaatgtggaatcttcttcacttacgccgctgacctcactcaacaccagaaagttcacaatagaggaaaaccgtatgagtgctgtgaatgtggaaaattcttcagccagcactccagccttgttaaacatcgcagggttcacaccggtgaaagccctcacgtgtgtggtgactgtgggaaattcttcagccgaagctccaacctcattcagcataagagggttcacactggtgaaaagccatatgagtgcagcgactgtgggaagttcttcagccagcgttccaacctcattcatcataagagggttcatacgggcagaagtgcccatgagtgcagtgaatgtgggaaatctttcaactgcaactccagcctaattaaacattggagagttcacactggagaaagaccttacaagtgtaacgaatgtgggaaattcttcagccacattgccagcctcattcaacatcagatagttcacactggcgagcggcctcacgggtgtggtgagtgtgggaaagccttcagccgaagctctgacctcatgaaacatcagcgagttcacactggtgagcggccttatgaatgcaatgaatgtgggaagttatttagccagagctccagcctcaatagccatcggagacttcacactggtgaacggccttaccagtgcagtgaatgtgggaaattctttaaccaaagctccagcctcaataaccaccggagacttcacaccggcgagcggccttatgagtgcagcgaatgtgggaaaaccttcaggcagaggtccaatctgaggcagcacctgaaagttcacaaaccagacaggccttacgaatgcagcgaatgtgggaaagccttcaaccaaaggcctaccctcattcggcatcagaagattcacatcagagaaaggagcatggagaatgtgctccttccctgttcacagcacacaccagagataagctctgagaacagaccttatcagggcgctgtcaactacaagttgaaacttgttcatccaagtacccaccctggggaggttccctaggaatgctagctgtgttggaagctttctggagacaagttacattctcttactgtagagtttatcagcgttttttcactgctggggttgtgatagaagccatgtcagcaccacacactgcagctctccaaagagtgtgtccaccactccactgtgctcagggaaggcagacctctcctctctctttccaatccctaaagggaattaggagtagtctgaagccttgggaagatgtcattcccgccctgtatggctggtttagccatggacatgaccagcttttggctgtgaagacctgagcagggttttgccaacagcttgttctagagaaggtttccctttttctgggacattgttggtctcatgttatgcctgtgaaggatttgtccagccttcatgttactctacacaacaacttatctcctgtgtattgccctggttcatgtgatgataatggccttatgataaagccgcctttagtcttccatgttctgatcactgtgtggggtggttcaagagcagagttaagatctaccaaactgaaggggtctccagattatcttggaggggacaggaggatggcagagaaacaactgtcaatccagatttgacctcatttgcattgccaccaaggcctcctaggaaaaattgtaggaatttatgggtataatattgtggtctgaatggcgtgaatttttatcccgaggagggggcagttgtgacaacctccagtgcatgtgggaacagcatgaattgggtcccttattcccagggggtgccccatattccccaatactgtaaagcagatgctgtttagcacctgccaaggagccatatgccctgaagttcagcattaggcaggtatctcttaactgtaagacataccaggcccagctgggaccataatttgtacagaaacactggatgtgattaatagggagtaggcgagattatagcaaaccagcagaaatggaactctgctaaatgtgcatccgtgaatgctcccttgaatgtggctgtgcaggattcagggtttgcagaaattctcaggacctcagacctctgtcctatgactaatgttactggcagagcaaataatctaaaggttttggttttgtggattaccatctccgtgctgtgcatctgaaggccagtgctgtgctggcaggaaaatagggactgagaaaaagcagatcctatactatagggactgtagtatctatgacgtagccagccattctttgctcccaaggcaagaagaaagagatgacagagtcaatatagggttgccaaatcggattttctaaaatgagtaggaagttggatttttatgtgcaacagtttcttttaatgctttgttgatatgtgattgtcatgcaataattattcatatttggtaagttttgtacatatattatgtacactcagggaaccaataccataatcatgataatgaacgtatccatcacctgcaaagctacctcatgcccctttacattccctccttgccttccctaggaaaccgttgatttacattttttactttagatttgtttgccttttctagaattaacacaattggaatcataaagtatttatactctc

SEQ ID NO: 131 - DNA, 4951 bp, Homo sapiens
cttttctctcgaagggcacccgaagattgtcacgagtccttagactccaactactgcggcagcttccaaatttcctgaaaaccctaagctgggccagcccggcagcccacgcacttccggcctcggacccgccccaaacacccaagcgccccagcgcctcatctctaggtccggaaataaacgaacatctccgattatggttataccagggtcgagggtttccgaatatattcgattcaaagcttcggcaagacgaagaaaaccgagcctgaaagcagggcgagaaaaggggcgctgcagggcggatggaaagaattgattggtaacgatgtggagacggaaacatccgaggacatccggaggaacccggggagttctgagtggtaatcgaggggtagagtatggcagtgggcggggtcatctcggtacgttcgaagggcgttggcggaaattaccgaagatgcccgaagccgtcgggacggacccgagtacctcacgcaagatggcggagctggaggaggtgactctggacgggaagcctcttcaggcgctgcgggtgaccgacctgaaggccgcactggagcagcgaggcctagccaagagcgggcagaagagtgccctggtcaagcggctcaaaggggctctaatgctagaaaatttacagaaacactcaacaccccatgctgcattccagccaaattcccagattggtgaggaaatgagccagaacagtttcataaaacagtatctggaaaagcagcaggagctacttaggcagcgtctggaacgtgaagctcgagaagctgcagaacttgaagaagcttcagctgagtcggaggacgagatgatccatcctgagggagtggcttccctgctgcctcctgactttcagagcagcctggagagaccagagctggagctcagcagacattcgcccagaaaaagctcctcaatttctgaagagaaaggtgactctgatgatgagaaaccaaggaaaggagaaagacgatcatctagggtcagacaggcaagagcagctaaactgtctgagggcagccaacctgctgaggaggaagaggatcaagaaacaccttccagaaacctaagggtcagagcagatcgaaatttgaaaacagaggaggaagaagaggaggaggaggaggaggaagaagatgatgaagaagaggaaggtgatgatgagggacaaaaatctagggaggcaccaatcctgaaagagtttaaggaagaaggggaagagatacctagagtaaaaccagaggagatgatggatgagagacccaaaacaagatcccaggaacaggaggtgttagagagaggagggagatttacaagatcccaggaagaggctagaaaaagtcatctggccagacagcagcaggagaaggaaatgaaaacaacatctccccttgaggaggaagaaagagaaataaaatcttcacaaggcttaaaggaaaaatcgaagtctccttcccctcctcgactgactgaagatcgaaagaaggcctcacttgtagcgctgccagagcaaactgccagcgaggaggagactcctccacctttactaacaaaggaagcatcttctccaccacctcatccacagctccatagcgaagaagaaatagagcccatggaaggcccagccccccctgtcctcattcagttatctcctcctaatacagatgctgacaccagggagctattagtatctcagcatactgtccagttggtaggaggcctgtctcctttgtcaagtccttcagacaccaaagcagaatctccagcagagaaagtgccagaggagagtgtcctgcctctggttcagaaaagcacactggctgactactcagcccagaaggatcttgaacctgagtcagacagatctgctcagcccctccctctaaaaattgaggaattagcactggccaaaggaatcactgaagaatgtctgaaacagccatctttggaacagaaggaaggcagaagagcttctcatacccttctcccaagccacagattgaaacagtcagctgattcatcctctagccggtcctcctcatcttcctcctccagttctagatcaagatctcgctctcctgacagttcaggttctcggtctcattcaccgctcagatccaagcagagagatgtagcccaggcacgtactcatgccaaccctcgtggtagacccaagatgggctccagatcaacatcagagtccagatcaaggtcacgttcacgttctcgttcagcatcaagcaacagcagaaaatctctgagccctggagtctccagggacagcagcaccagctatactgaaaccaaagatccctcttctggtcaggaggttgcaactccaccagtgccacaactgcaggtctgtgagccaaaggagaggacttccacctcctcatcctctgtccaagcaaggcgtctgagtcagcctgaatcagctgaaaagcatgtgacccagaggttacagcctgagcgggggagcccaaagaagtgtgaagctgaagaggcagagccaccagctgccacacagccccaaacctcagagactcagacctctcatctgccagaatcagaaagaattcatcacactgttgaggagaaggaggaagtgaccatggacacaagtgaaaacagacctgaaaatgatgttccagaacctcccatgcctattgcagaccaagtcagcaatgatgaccgcccggagggcagtgttgaagatgaggagaagaaagagagctcgctgcccaaatcattcaagaggaagatctccgttgtctcagctaccaagggggtgccagctggaaacagtgacacagaggggggccagcctggtcggaaacgacgctggggagccagcacagccaccacacagaagaaaccttccatcagtatcaccactgaatcactaaagagcctcatccccgacatcaaacccctggcggggcaggaggctgttgtggatcttcatgctgatgactctcgcatctctgaggatgagacagagcgtaatggcgatgatgggacccatgacaaggggctgaaaatatgccggacagtcactcaggtagtacctgcagagggccaggagaatgggcagagggaagaagaggaagaagagaaggaacctgaagcagaacctcctgtacctccccaggtgtcagtagaggtggccttgcccccacctgcagagcatgaagtaaagaaagtgactttaggagataccttaactcgacgttccattagccagcagaagtccggagtttccattaccattgatgacccagtccgaactgcccaggtgccctccccaccccggggcaagattagcaacattgtccatatctccaatttggtccgtcctttcactttaggccagctaaaggagttgttggggcgcacaggaaccttggtggaagaggccttctggattgacaagatcaaatctcattgctttgtaacgtactcaacagtagaggaagctgttgccacccgcacagctctgcacggggtcaaatggccccagtccaatcccaaattcctttgtgctgactatgccgagcaagatgagctggattatcaccgaggcctcttggtggaccgtccctctgaaactaagacagaggagcagggaataccacggcccctgcaccccccacccccacccccggtccagccaccacagcacccccgggcagagcagcgggagcaggaacgggcagtgcgggaacagtgggcagaacgggaacgggaaatggagcggcgggagcggactcgatcagagcgtgaatgggatcgggacaaagttcgagaagggccccgttcccgatcaaggtcccgtgaccgccgccgcaaggaacgtgcgaagtctaaagaaaagaagagtgagaagaaagagaaagcccaggaggaaccacctgccaagctgctggatgaccttttccgaaagaccaaggcagctccctgcatctattggctcccactgactgacagccagatcgttcagaaagaggcagagcgggccgaacgggccaaggagcgggagaagcggcgaaaggagcaagaagaagaagagcaaaaggagcgggagaaggaagccgagcgggaacggaaccgacagctggagcgagagaaacgtcgggagcacagtcgggagagggacagggagagagagagagaaagggagcgggacaggggggaccgagatcgggatagggaaagggaccgagaacgaggcagggaaagggatcgcagggacaccaagcgccacagcagaagccggagtcggagcacacctgtgcgggaccggggtgggcgccgctagctgggaaaacactagagctgcaggtaccagccactcggccccagggggttatggccacagagggataggcacagtctccaccaccctggagccaagggtctttcacatcacctatccctacatacataccaaatggaaaagtggccatccttttccccccaaacacacccccttaacctatctcttgggacttagcccgaccctccctctcatttcccattaagtctgagaggcaagagctaggttaggcaaggaggtggttggccagagatggggaacagccaggtgccccagtcctctgatttttcctccatcctgcttaccacctccctgggtacttacagccttctcttgggaacagccggggccaggactgggtcacctatgagctgaatcagcatctcctcctgagtcccagggcccctgcagttcccagtctcttctgtcctgcagcccttgcctctttcccacaggttccactttatatccaccttttccttttgttcaatttttatttttattttttttattattaaatgatgtggtctatggaaaaaaaaataaaaatctgacttagttttaaaaaaaaaaaaaaaa

SEQ ID NO: 132 - DNA, 1422 bp, Homo sapiens
acagtcagggaagggcgctgagaggcgagcgtgagcccagcgacaggagagtgagctcaccacgcgcagcgccatgaccagcaagggtcccgaggaggagcacccatcggtgacgctcttccgccagtacctgcgtatccgcactgtccagcccaagcctgactatggagctgctgtggctttctttgaggagacagcccgccagctgggcctgggctgtcagaaagtagaggtggcacctggctatgtggtgaccgtgttgacctggccaggcaccaaccctacactctcctccatcttgctcaactcccacacggatgtggtgcctgtcttcaaggaacattggagtcacgacccctttgaggccttcaaggattctgagggctacatctatgccaggggtgcccaggacatgaagtgcgtcagcatccagtacctggaagctgtgaggaggctgaaggtggagggccaccggttccccagaaccatccacatgacctttgtgcctgatgaggaggttgggggtcaccaaggcatggagctgttcgtgcagcggcctgagttccacgccctgagggcaggctttgccctggatgagggcatagccaatcccactgatgccttcactgtcttttatagtgagcggagtccctggtgggtgcgggttaccagcactgggaggccaggccatgcctcacgcttcatggaggacacagcagcagagaagctgcacaaggttgtaaactccatcctggcattccgggagaaggaatggcagaggctgcagtcaaacccccacctgaaagaggggtccgtgacctccgtgaacctgactaagctagagggtggcgtggcctataacgtgatacctgccaccatgagcgccagctttgacttccgtgtggcaccggatgtggacttcaaggcttttgaggagcagctgcagagctggtgccaggcagctggcgagggggtcaccctagagtttgctcagaagtggatgcacccccaagtgacacctactgatgactcaaacccttggtgggcagcttttagccgggtctgcaaggatatgaacctcactctggagcctgagatcatgcctgctgccactgacaaccgctatatccgcgcggtgggggtcccagctctaggcttctcacccatgaaccgcacacctgtgctgctgcacgaccacgatgaacggctgcatgaggctgtgttcctccgtggggtggacatatatacacgcctgctgcctgcccttgccagtgtgcctgccctgcccagtgacagctgagccctggaactcctaaacctttgcccctggggcttccatcccaaccagtgccaaggacctcctcttcccccttccaaataataaagtctatggacagggctgtctctgaagtactaacacaa

SEQ ID NO: 133 - DNA, 1754 bp, Homo sapiens
tggagcagcggggcctggcacacagtaggcgttctataaatgtgtcacaagaatggcttccctcaggaaggcggcattaccgctgcctttctgcagaaaaggaaactaaggctcagcaagaaccaccgcccagccagagccaaggtcacagagcacgtccgtggcacgcgtccaggtcgtgccacagcagggccggcggcttcgacgcgggcagccgggtcccttttctttgacagatggggaaaccgaggcccggccggctgccggggctcctcgcacctaccccagcaactcaaattcaccacctcggactcctgcgaccgcatcaaagacgaatttcagctactgcaagctcagtaccacagcctcaagctcgaatgtgacaagttggccagtgagaagtcagagatgcagcgtcactatgtgatgtactacgagatgtcctacggcttgaacatcgagatgcacaaacaggctgagatcgtcaaaaggctgaacgggatttgtgcccaggtcctgccctacctctcccaagagcaccagcagcaggtcttgggagccattgagagggccaagcaggtcaccgctcccgagctgaactctatcatccgacagcagctccaagcccaccagctgtcccagctgcaggccctggccctgcccttgaccccactacccgtggggctgcagccgccttcgctgccggcggtcagcgcaggcaccggcctcctctcgctgtccgcgctgggttcccaggcccacctctccaaggaagacaagaacgggcacgatggtgacacccaccaggaggatgatggcgagaagtcggattagcagggggccgggacagggaggttgggaggggggacagaggggagacagaggcacggagagaaaggaatgtttagcacaagacacagcggagctcgggattggctaaactcccatagtatttatggtggccgccggcgggggccccagcccagcttgcaggccacctctagctttcttcctaccccattcccggcttccctcctcctcccctgcagcctggttaggtggatacctgccctgacatgtgaggcaagctaaggcctggagggtcagatgggagaccaggtcccaagggagcaagacctcgcgaagcgcagcagccccggcccttcccccgttttgaacatgtgtaaccgacagtctgcctgggccacagccctctcaccctggtactgcatgcacgcaatgctagctgcccctttcccgtcctgggcaccccgagtctcccccgaccccgggtcccaggtatgctcccacctccacctgccccactcaccacctctgctagttccagacacctccacgcccacctggtcctctcccatcgcccacaaaagggggggcacgagggacgagcttagctgagctgggaggagcagggtgagggtgggcgacccaggattccccctccccttcccaaataaagatgagggtactaaagttgtcttggtttttattttattattatttttttctttttccagtatactagcttgtcttttaagaaaggggatattaaaaaaaaaaaaagacaaaagtgtttttaaaaaaaagcaacacccacacctgtgtctgtatatagtcagcttatctcgtgttcaatcgtctgatctctacagagagaagtggaaaatgctgtatcaagggtgggcttagctgtgcctttccaataaagatgtgagaagcttcaaaaaaaaaaa

SEQ ID NO: 134 - DNA, 2598 bp, Homo sapiens
cccgtaccaggaagcgctggggggcagaggagcggagttgaggcagaagccagtcaggatggtggtgccttcgctgaagcttcaggacctcatcgaagagattcgcggggccaagactcaggcccaggagcgggaggtgatccaaaaggagtgtgcccacatccgggcctccttccgcgacggggacccagtgcacaggcaccggcagctggccaaactgctctacgtccacatgttgggctaccccgcccactttggacagatggagtgcctgaaactgatcgcctcctccagattcacagacaagagggtgggctacctgggggccatgcttctattggatgagaggcacgatgcccacctgctcattaccaacagcatcaagaatgacctgagccaggggattcagccagtacaaggcctggccttgtgcactttgagcaccatgggctctgctgagatgtgccgagacctggccccagaggtggagaaactgctcctgcagcccagtccctacgtgcgcaagaaggctattctgactgcagtgcacatgatccggaaggtccctgaactctccagtgtcttcctcccaccctgtgcccaactgcttcatgagcgtcaccatggcatcctgctgggcaccatcacgctgatcacggagctctgcgaacgaagccctgcagccctcaggcacttccgaaaggtggtaccccagctggtacacatcctccggactctggtgacaatgggatactccacagaacacagcatatctggagtcagcgaccccttcctgcaggtccagatacttcgtctgcttcggatcctgggccggaaccacgaggagagcagtgagaccatgaatgacttgctggcccaggtggccactaacacggacaccagccgaaatgccggaaatgcggtcctgtttgagacagtactcaccatcatggatatccgctctgcagctggcctacgggttctagctgtcaacattcttggtcgcttcctactcaacagtgacaggaacattaggtatgtagccctgacatcactgcttcgactggtgcagtctgatcacagtgctgtgcagcggcatcggcccactgtggtggaatgtctacgggaaactgatgcctccctcagccggagagccctggaactaagcctggctctggtaaatagctccaatgtgcgagccatgatgcaagagctgcaggcctttctggagtcctgccctcctgacctacgggctgactgtgcctcaggcatcctgctggctgcagagaggtttgctccaaccaaacgctggcacatagacaccatcctgcatgtgctgacaacggcgggcacccatgtgcgggatgatgcagtggccaacctgacccagctgattgggggggcccaggagctacatgcctactctgtgcgccgcctctacaatgccctggcagaagacatttcccagcaaccactggtgcaggtggcagcctggtgcattggggagtatggggacctcctgctggcagggaactgcgaggagattgagccccttcaggtggacgaagaggaagtgctggcattgctggaaaaggtgctgcagtcccacatgtccctgccagccactcgaggatatgccctcacagccctcatgaagctcagcactcgcctctgtggggacaacaaccgcatccgccaggtggtgtccatctacgggagctgcttggacgtggagctgcagcagcgggctgtggagtatgacacactcttccggaaatacgaccacatgagggctgccatcctggaaaaaatgcctcttgtggagcgagatggccctcaggctgatgaggaagcaaaggaaagcaaagaagcagcccagctttcagaagcagccccagtgcccacagagccccaggcctcacagctcctggatctgctagatctcctggatggggcttctggggatgtccagcatcctccccatctggacccctccccaggaggtgccctggtacacctgcttgaccttccctgtgtacctccacccccagctcccatcccagatctcaaagtgtttgagcgtgagggagtacagctgaatctgtctttcattcgaccccctgaaaaccctgctttgctgttaatcaccatcactgccaccaacttctcagagggtgatgtcacccatttcatctgccaggctgctgtgcccaagagtctccagctgcagctgcaggcccccagtgggaacacagttccagctcggggtggccttcctatcacccagctcttcagaatcctcaatcctaacaaggcccccctgcggctaaagctgcgcctcacctacgaccactttcaccagtcggtgcaggagatctttgaggtgaacaacttgcctgtggaatcgtggcagtaactgtctccactcacagcctgaaattctcctgtgtcccaaaccccagggggccccagcagcttcgaacctacacctgagggctaccagcaggtggcgctctggctttgcactgcaaaaactggggaccagcccccttctcccacaaataaagcccaataaagcctgagaagtgaggaaagcca

SEQ ID NO: 135 - DNA, 2795 bp, Homo sapiens
attatacagacgcataactggaggtgggatccacacagctcagaacagctggatcttgctcagtctctgccaggggaagattccttggaggaggccctgcagcgacatggagggagctgctttgctgagagtctctgtcctctgcatctggatgagtgcacttttccttggtgtgggagtgagggcagaggaagctggagcgagggtgcaacaaaacgttccaagtgggacagatactggagatcctcaaagtaagcccctcggtgactgggctgctggcaccatggacccagagagcagtatctttattgaggatgccattaagtatttcaaggaaaaagtgagcacacagaatctgctactcctgctgactgataatgaggcctggaacggattcgtggctgctgctgaactgcccaggaatgaggcagatgagctccgtaaagctctggacaaccttgcaagacaaatgatcatgaaagacaaaaactggcacgataaaggccagcagtacagaaactggtttctgaaagagtttcctcggttgaaaagtgagcttgaggataacataagaaggctccgtgcccttgcagatggggttcagaaggtccacaaaggcaccaccatcgccaatgtggtgtctggctctctcagcatttcctctggcatcctgaccctcgtcggcatgggtctggcacccttcacagagggaggcagccttgtactcttggaacctgggatggagttgggaatcacagccgctttgaccgggattaccagcagtaccatggactacggaaagaagtggtggacacaagcccaagcccacgacctggtcatcaaaagccttgacaaattgaaggaggtgagggagtttttgggtgagaacatatccaactttctttccttagctggcaatacttaccaactcacacgaggcattgggaaggacatccgtgccctcagacgagccagagccaatcttcagtcagtaccgcatgcctcagcctcacgcccccgggtcactgagccaatctcagctgaaagcggtgaacaggtggagagggttaatgaacccagcatcctggaaatgagcagaggagtcaagctcacggatgtggcccctgtaagcttctttcttgtgctggatgtagtctacctcgtgtacgaatcaaagcacttacatgagggggcaaagtcagagacagctgaggagctgaagaaggtggctcaggagctggaggagaagctaaacattctcaacaataattataagattctgcaggcggaccaagaactgtgaccacagggcagggcagccaccaggagagatatgcctggcaggggccaggacaaaatgcaaacttttttttttttctgagacagagtcttgctctgtcgccaagttggagtgcaatggtgcgatctcagctcactgcaagctctgcctcccgtgttcaagcgattctcctgccttggcctcccaagtagctgggactacaggcgcctaccaccatgcccagctaatttttgtatttttaatagagatggggtttcaccatgttggccaggatggtctcgatctcctgacctcttgatctgcccaccttggcctcccaaagtgctgggattacaggcgtgagccatcgcttttgacccaaatgcaaacattttattagggggataaagagggtgaggtaaagtttatggaactgagtgttagggactttggcatttccatagctgagcacagcaggggaggggttaatgcagatggcagtgcagcaaggagaaggcaggaacattggagcctgcaataagggaaaaatgggaactggagagtgtggggaatgggaagaagcagtttactttagactaaagaatatattggggggccgggtgtagtggctcatgcctgtaatccgagcactttgggaggccaaggcgggcggatcacgaggtcaggagatcgagaccatcctggctaacacagtgaaaccccgtctctactaaaaatacaaaaaattagccgggcatggtggcgggcgcctgtagttccagctaactgggcggctgaggcaggagaatggcgtgaacctgggaggtggagcttgcagtgagccgagatatcgccactgcactccagcctgggtgacagagcgagactccatctcaaaaaaaaaaaaaaaaagaatatattgacggaagaatagagaggaggcttgaaggaaccagcaatgagaaggccaggaaaagaaagagctgaaaatggagaaagcccaagagttagaacagttggatacaggagaagaaacagcggctccactacagacccagccccaggttcaatgtcctccgaagaatgaagtctttccctggtgatggtcccctgccctgtctttccagcatccactctcccttgtcctcctgggggcatatctcagtcaggcagcggcttcctgatgatggtcattggggtggttgtcatgtgatgggtcccctccaggttactaaagggtgcatgtcccctgcttgaacactgaagggcaggtggtgggccatggccatggtccccagctgaggagcaggtgtccctgagaacccaaacttcccagagagtatgtgagaaccaaccaatgaaaacagtcccatcgctcttacccggtaagtaaacagtcagaaaattagcatgaaagcagtttagcattgggaggaagctcagatctctagagctgtcttgtcgccgcccaggattgacctgtgtgtaagtcccaataaactcacctactcatcaa

SEQ ID NO: 136 - DNA, 1333 bp, Homo sapiens
cactcagcttcactccaccatgaccagagcacctctcctgctactatgtgttgccctggtgctgcttgggcatgtgaatggagccacagtaagaaatgaggacaaatggaagccactcaacaaccccagaaacagagatctgtttttcagaaggcttcaggcatattttaagggcagaggtcttgatcttggaacatttccaaatcctttccccacgaatgaaaatcctagacctctctctttccagtcagaacttactgcttctgcatctgcagattatgaagagcagaaaaactcctttcacaattatctcaaaggctgaaagtttcttctgagctcaggtgtctggctattttaaaactacagatgaagcttctcattagaaaaattcaaccattgtcatagctaaactttcatggagtttctttccccctcacttttatttttcagtttgtaatgattttattccacatttccatatttacatataaatcgctggaactatgatttctatgcatatttatggagtttttttcctatgaaaccataaatattgatgtagagcaccgcatgtatttgtaggagttacaaaaacatcacaaactgaaaaaagattataatctaaattagatgtttctttaagcttgtttttaaaacttgtcttttatgtttattatcttttatcgaccaatatatttttttaaagggacatgctcacttttagtatagtaaaattcattatatgtgatagagggttgggtttaaaatttgtcttcctttcctaaaaagaagatgcattcccatgttcagcatacactaccaaaatacttcacagttttagtttcataagaaatgagggcaagtgataaacagccacaattaagttaaaatggaagcaaacaacaacaacaaacatgggattctagaagttgtcaacgcctccaaagatgctctttgccagagtattcagaggtggacattgtgccacatcaaatattctagcaatgcccgagcccttgctctcatacacaacctcctcaggaaggaaaagtagaaacaggtgatttcctctctttccaaccagcccctgctctccttactctagctcatgctgagttattctgattcccatactcacatttggaatagctgcttttcctgtatctttatagatagctgcatcatcttctctgtgattcctgcaaaaggaatgttgcactaaaatgcaacattgtcctaacattagtctgtgcatttcaaaatattttaatgtggcttttttgggtggattattgatattgtatatgaagaataaaatatttgtgcaagaaca

SEQ ID NO: 137 - DNA, 3440 bp, Homo sapiens
actattgtgcggctgcaggaggtgtcgagcggcgttatttttttttgcggtttgcctttttttttcttttttttttttttggaaccgcggttgtttaaaagcctgagggaacctggagaggggctcccactccctaccctctttcctccgagtttgtgactccgagatggacaaagtgtgtgctgtttttggaggctcccgaggcattggcagagctgtggcccagttaatggcccggaaaggctaccgactggcggtcattgccagaaacctggaaggggccaaagccgccgccggtgacctcggcggagatcatttggcatttagctgtgatgttgctaaagaacatgatgttcaaaatacatttgaagagctggagaaacatttaggtcgagtaaatttcttggtaaatgcagctggtattaacagggatggtcttttagtaagaacaaaaactgaagatatggtatctcagcttcatactaacctcttgggttccatgctgacctgtaaagctgccatgaggactatgattcaacaacagggagggtctattgttaatgtaggaagcattgttggcttaaaaggcaactctggccagtccgtttacagtgccagtaaaggaggattagttggattttcacgtgctcttgctaaagaggtagcaagaaagaaaattagagtgaatgtagttgcaccaggatttgtacacacagatatgacgaaagacttgaaagaagaacatttaaagaaaaatattcctcttgggaggtttggagaaactattgaggtggcacatgcggttgtgtttcttttagaatcaccgtatattacagggcatgttctggtagtggatgggggattacaactcattttgtaatttgcagattattcagttataggggtgattagcatcaagggcacactttggctactgattagacaattatacctacatgggtaacatgtgctaatcaaacctgctgatgctacaaatgttaatttctgtctttataaaaatatgtctcaaaagaacaatgtgtgacaaattgtggtttttttttttttggtctaagttacatcagtgttgttttgtttaaaaagccttcatgagatacaattcacataccatataatcacacatttaaaatacacaattcagtggttttaacatatttaaatacatgtgcaatcatccccccagacaaattgtgttttctaaaggatgtgtatcacttacctttggttacctcatagactgtagcaatcttagtgtatagacattttgcaagtcatataaacaagtattgatttatatattttgtctcaaaagtggaaaaattatattgtctaattatgatgaattattttcttgtatcaagctgaattttctaaaagttaaccttgtgggctgttgccaaaataagagtatttagaggacactgattagttgtcaatactttagcaagcccactaaagataactatattccttttgcatgtgcttgggtgatcagtttttatacaggttgcaaaacatagtattcattaaagacatgaatttagaattgatttctttgagtggtatttctcttgattgagcagctagacaaaataatctgcaaatttaaatgtggcgcatttgactcattcttgagaaattctcataagtgaagaggattagcccttaaggttttaatacctggtacagtagtgaaccgcacagatttcatgaacttaggatgtgttttttattcatgaaaaacttagaatagtgaactattaatatttaaaaacgagaaatacaacatttaaaaaattaagagtattttgcattagtgattatgattcttatcccaaaattctagaaagtaataaattctgtatgaataagcataaaaaataaataaatatgcaataacattaaattaaatgtctttacaagaagcagtgaaggcactggtcttaagtgagaatatttgcctgggagtagagataaagacacaaaccgaatgtgaaataccaggtaataattattttgcattaaactctttttatcgggaatagtatgatattttcagtgtcactccattcatgttgatttggagctgacagttattttgtgtaagcagagatttaattttatattgaaagtcagtgcaaaattatgaataggatatactaataaatacaaagtaataacaaaagtcaaagcagtgttctaaataaaaattctgggttccttaaaaattattttaaatttatctttgaaatagttttcttagattaatctcaggatatgagaaagtcaattaagtgtgagtaaagttagtatcattaaacaaattgtctattaaatgcaagacgtggtaatatacagaatttatcaggcattaccaagtctaggcacatataggaaatgcagcactcagaatggtttcaatgtagtagttgatgcttgtaaggtaggggagcttattcagacatagtagatagtttctctaatgctgtctcaattgctggcctttggctacctgtacttccccattatggcagcccattcagtcttgagttttcttctctggacaccttatgctctgaaatcatgagcgaggctgattcaattggtgatttgggtagaaagcagtatgttttgctgacattaagatgtaggttatagataggtttagcctttaagtgtatgtttttatactttaaaataagaaatataaccttttaagctattccacctcctcccccagcctatctcaaactggtggaatatatggagagatcttgaaagaggtaaaataaaccttcactgctccactccaggtgaatccgcccactcccactgacctagtagaatttgtaatttaatacttaccttctatttctgaaatcagttgtgaactgttgccttatgttcagaggtttaagaacctcagtgaattcattttttaaaatctgctattctgagaagcattgaatgaattcttaacaagaagactcatctgtagctgtttgctgactcctatgagcccataagggttctgtgcttagcattaacaaaataaggtttataggtaaagccaatgtattaatttttttttgcatggagggctttaaaatttgtgctctttttcatattttattcatattcaatttatggtttgtaactgctttttagggagataattatatgttataaattagttttggggggaataattgtgcaaagaggataatttaatttacgtgcttctgttattcagaataaagagagaagactacgctgcatattcaagagttgtaccttaacattggtgaaacattttttctaagattttcaaaaggaatatgtgtaaattgagaaatcataaccactgtcctaacttggtaaacaaactgttcttaaataaagtatttaatgattttaaa

SEQ ID NO: 138 - DNA, 3211 bp, Homo sapiens
gaacaaaccaacatttgagccaggaataactagagaggaacaatggggttattcagaggttttgttttcctcttagttctgtgcctgctgcaccagtcaaatacttccttcattaagctgaataataatggctttgaagatattgtcattgttatagatcctagtgtgccagaagatgaaaaaataattgaacaaatagaggatatggtgactacagcttctacgtacctgtttgaagccacagaaaaaagattttttttcaaaaatgtatctatattaattcctgagaattggaaggaaaatcctcagtacaaaaggccaaaacatgaaaaccataaacatgctgatgttatagttgcaccacctacactcccaggtagagatgaaccatacaccaagcagttcacagaatgtggagagaaaggcgaatacattcacttcacccctgaccttctacttggaaaaaaacaaaatgaatatggaccaccaggcaaactgtttgtccatgagtgggctcacctccggtggggagtgtttgatgagtacaatgaagatcagcctttctaccgtgctaagtcaaaaaaaatcgaagcaacaaggtgttccgcaggtatctctggtagaaatagagtttataagtgtcaaggaggcagctgtcttagtagagcatgcagaattgattctacaacaaaactgtatggaaaagattgtcaattctttcctgataaagtacaaacagaaaaagcatccataatgtttatgcaaagtattgattctgttgttgaattttgtaacgaaaaaacccataatcaagaagctccaagcctacaaaacataaagtgcaattttagaagtacatgggaggtgattagcaattctgaggattttaaaaacaccatacccatggtgacaccacctcctccacctgtcttctcattgctgaagatcagtcaaagaattgtgtgcttagttcttgataagtctggaagcatggggggtaaggaccgcctaaatcgaatgaatcaagcagcaaaacatttcctgctgcagactgttgaaaatggatcctgggtggggatggttcactttgatagtactgccactattgtaaataagctaatccaaataaaaagcagtgatgaaagaaacacactcatggcaggattacctacatatcctctgggaggaacttccatctgctctggaattaaatatgcatttcaggtgattggagagctacattcccaactcgatggatccgaagtactgctgctgactgatggggaggataacactgcaagttcttgtattgatgaagtgaaacaaagtggggccattgttcattttattgctttgggaagagctgctgatgaagcagtaatagagatgagcaagataacaggaggaagtcatttttatgtttcagatgaagctcagaacaatggcctcattgatgcttttggggctcttacatcaggaaatactgatctctcccagaagtcccttcagctcgaaagtaagggattaacactgaatagtaatgcctggatgaacgacactgtcataattgatagtacagtgggaaaggacacgttctttctcatcacatggaacagtctgcctcccagtatttctctctgggatcccagtggaacaataatggaaaatttcacagtggatgcaacttccaaaatggcctatctcagtattccaggaactgcaaaggtgggcacttgggcatacaatcttcaagccaaagcgaacccagaaacattaactattacagtaacttctcgagcagcaaattcttctgtgcctccaatcacagtgaatgctaaaatgaataaggacgtaaacagtttccccagcccaatgattgtttacgcagaaattctacaaggatatgtacctgttcttggagccaatgtgactgctttcattgaatcacagaatggacatacagaagttttggaacttttggataatggtgcaggcgctgattctttcaagaatgatggagtctactccaggtattttacagcatatacagaaaatggcagatatagcttaaaagttcgggctcatggaggagcaaacactgccaggctaaaattacggcctccactgaatagagccgcgtacataccaggctgggtagtgaacggggaaattgaagcaaacccgccaagacctgaaattgatgaggatactcagaccaccttggaggatttcagccgaacagcatccggaggtgcatttgtggtatcacaagtcccaagccttcccttgcctgaccaatacccaccaagtcaaatcacagaccttgatgccacagttcatgaggataagattattcttacatggacagcaccaggagataattttgatgttggaaaagttcaacgttatatcataagaataagtgcaagtattcttgatctaagagacagttttgatgatgctcttcaagtaaatactactgatctgtcaccaaaggaggccaactccaaggaaagctttgcatttaaaccagaaaatatctcagaagaaaatgcaacccacatatttattgccattaaaagtatagataaaagcaatttgacatcaaaagtatccaacattgcacaagtaactttgtttatccctcaagcaaatcctgatgacattgatcctacacctactcctactcctactcctactcctgataaaagtcataattctggagttaatatttctacgctggtattgtctgtgattgggtctgttgtaattgttaactttattttaagtaccaccatttgaaccttaacgaagaaaaaaatcttcaagtagacctagaagagagttttaaaaaacaaaacaatgtaagtaaaggatatttctgaatcttaaaattcatcccatgtgtgatcataaactcataaaaataattttaagatgtcggaaaaggatactttgattaaataaaaacactcatggatatgtaaaaactgtcaagattaaaatttaatagtttcatttatttgttattttatttgtaagaaatagtgatgaacaaagatcctttttcatactgatacctggttgtatattatttgatgcaacagttttctgaaatgatatttcaaattgcatcaagaaattaaaatcatctatctgagtagtcaaaatacaagtaaaggagagcaaataaacaacatttggaaaaaaa

SEQ ID NO: 139 - DNA, 1847 bp, Homo sapiens
attttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcagcagcagtcataaaagaaggaagagatcacatagcagtgcccaggagaacaagcgctgcaaatacaatcactctaaaatgtgtgatagccattatttggaaagcaggtctataaatgagaaagattatcatagtcgacgctacattgatgagtacagaaatgactacactcaaggatgtgaacctggacatcgccaaagagaccatgaaagccggtatcagaaccatagtagcaagtcttctggtagaagtggaagaagtagttataaaagcaaacacaggattcaccacagtacttcacatcgtcgttcacatgggaagagtcaccgaaggaaaagaaccaggagtgtagaggatgatgaggagggtcacctgatctgtcagagtggagacgtactaagtgcaagatatgaaattgttgatactttaggtgaaggagcttttggaaaagttgtggagtgcatcgatcataaagcgggaggtagacatgtagcagtaaaaatagttaaaaatgtggatagatactgtgaagctgctcgctcagaaatacaagttctggaacatctgaatacaacagaccccaacagtactttccgctgtgtccagatgttggaatggtttgagcatcatggtcacatttgcattgtttttgaactattgggacttagtacttacgacttcattaaagaaaatggttttctaccatttcgactggatcatatcagaaagatggcatatcagatatgcaagtctgtgaattttttgcacagtaataagttgactcacacagacttaaagcctgaaaacatcttatttgtgcagtctgactacacagaggcgtataatcccaaaataaaacgtgatgaacgcaccttaataaatccagatattaaagttgtagactttggtagtgcaacatatgatgacgaacatcacagtacattggtatctacaagacattatagagcacctgaagttattttagccctagggtggtcccaaccatgtgatgtctggagcataggatgcattcttattgaatactatcttgggtttaccgtatttccaacacacgatagtaaggagcatttagcaatgatggaaaggattcttggacctctaccaaaacatatgatacagaaaaccaggaaacgtaaatattttcaccacgatcgattagactgggatgaacacagttctgccggcagatatgtttcaagacgctgtaaacctctgaaggaatttatgctttctcaagatgttgaacatgagcgtctctttgacctcattcagaaaatgttggagtatgatccagccaaaagaattactctcagagaagccttaaagcatcctttctttgaccttctgaagaaaagtatatagatctgtaattggacagctctctcgaagagatcttacagactgtatcagtctaatttttaaattttaagttattttgtacagctttgtaaattcttaacatttttatattgccatgtttattttgtttgggtaatttggttcattaagtacatagctaaggtaatgaacatctttttcagtaattgtaaagtgatttattcagaataaattttttgtgcttatgaagttgatatgtatctgaacagtttgttctaagtaccatttttcttcctacttctattaaagaatggacataga

SEQ ID NO: 140 - DNA, 1720 bp, Homo sapiens
gctgtgcagggcagggaagctccaggcaaacagcccagcaaacagcagcactcagctaaaaggaagactcacagaacacagttgaagaaggaaagtggcgatggacctcatcccaaatttggcggtggaaacctggcttctcctggctgtcagcctggtgctcctctatctatatgggacccgtacacatggactttttaagagactgggaattccagggcccacacctctgcctttgttgggaaatgttttgtcctatcgtcagggtctctggaaatttgacacagagtgctataaaaagtatggaaaaatgtggggaacgtatgaaggtcaactccctgtgctggccatcacagatcccgacgtgatcagaacagtgctagtgaaagaatgttattctgtcttcacaaatcgaaggtctttaggcccagtgggatttatgaaaagtgccatctctttagctgaggatgaagaatggaagagaatacggtcattgctgtctccaaccttcaccagcggaaaactcaaggagatgttccccatcattgcccagtatggagatgtattggtgagaaacttgaggcgggaagcagagaaaggcaagcctgtcaccttgaaagacatctttggggcctacagcatggatgtgattactggcacatcatttggagtgaacatcgactctctcaacaatccacaagacccctttgtggagagcactaagaagttcctaaaatttggtttcttagatccattatttctctcaataatactctttccattccttaccccagtttttgaagcattaaatgtctctctgtttccaaaagataccataaattttttaagtaaatctgtaaacagaatgaagaaaagtcgcctcaacgacaaacaaaagcaccgactagatttccttcagctgatgattgactcccagaattcgaaagaaactgagtcccacaaagctctgtctgatctggagctcgcagcccagtcaataatcttcatttttgctggctatgaaaccaccagcagtgttctttccttcactttatatgaactggccactcaccctgatgtccagcagaaactgcaaaaggagattgatgcagttttgcccaataaggcaccacctacctatgatgccgtggtacagatggagtaccttgacatggtggtgaatgaaacactcagattattcccagttgctattagacttgagaggacttgcaagaaagatgttgaaatcaatggggtattcattcccaaagggtcaatggtggtgattccaacttatgctcttcaccatgacccaaagtactggacagagcctgaggagttccgccctgaaaggttcagtaagaagaaggacagcatagatccttacatatacacaccctttggaactggacccagaaactgcattggcatgaggtttgctctcatgaacatgaaacttgctctaatcagagtccttcagaacttctccttcaaaccttgtaaagaaacacagatccccttgaaattagacacgcaaggacttcttcaaccagaaaaacccattgttctaaaggtggattcaagagatggaaccctaagtggagaatgagttattctaaggatttctactttggtcttcaagaaagctgtgccccagaacaccagagatttcaacttagtcaataaaaccttgaaataaagatgggcttaatctaatgta

SEQ ID NO: 141 - DNA, 2400 bp, Homo sapiens
gccattgctgcgagcaggagcaggagacgcggagctcggagcgctcagctgacctgccggagccgggcgtgggctgcagcctcggagctcccggaacgatggtgaagttggggaacaatttcgcagagaagggcaccaagcagccgctgctggaggatggcttcgacaccattcccctgatgacgcccctcgatgtcaatcagctgcagttcccgcccccggataagtggaacgcggtggggcaagattccttcgcgtttttcctgggagcctcatccgagagggccctggccccgcagctgccctgctcctcccttgccccgtggccccaggggctctggatcgggggtggtcgtgaaaactaagaccgagtatgaacctgaccgcaagaaagggaaagcacgtcctccccaaattgctgagttcaccgtcagcatcacggagggtgtcaccgagaggtttaaggtctccgtgttggtcctcttcgccctggccttcctcacctgcgtcgtcttcctggttgtctacaaggtgtacaagtatgaccgcgcctgccccgatgggttcgtcctcaagaacacccagtgcatcccagaaggcttggagagctactacgcggagcaagactccagtgcccgggagaaattttacacagtcataaaccactacaacctggccaagcagagcatcacgcgctccgtatcgccctggatgtcagttctgtcagaagagaagctgtccgagcaggagactgaagcggctgagaagtcagcttagcgggatgggcaagttccttacaatgtgtcacttgcaaataacaaagggactttgagggacatttcattaaatataattactgatactttagaggttactcatttacggtgcaattgcttctgtttgctaatgctgctttgcaaataaaacttgctgccgaccacccacgggcataaaatcaagtgcatttcagcattgcctaaagagctctgacaccacttttcatgttaagatcttcatttagctcctttactgggatttattggatgctgtaaaaaaataaatttacactggatatgcgaagggtttggatctcagataaatgcattttgtggaattgattttctgaaccgaccctgctgtctgcaaaccttcctccatagccatatctagagtgatctctcgctgtgctaagagcaagcctacttcgcatttcttcctcggccatcagcgggtaacagtgctgactgctgccaaggtgcactgtagtaagtaagtggcatagagaacgaggaaaaagacccccccacccctccctgtgctgactcctgagtcggggtgggacggccctgcaatgtggcaggctcggtgtggattgactactccctcccctctgactctggcatcttggtaaggagggaggggcaccacccatctgggtggagacagctggggtttgctccagtgtgtgtagactggcagagcatgtgagggagagggctgggaagagacggccctgggcccgtgaggtgcagaactctccctgcaggtagtctgtctgctctgtgatgtgctgataggaaagagcccccactggccctctggttcacttctattatgaataaatttgcaccaatagccccattagtttttaaagaaatgagctgggtgggaaaagtggaaatgtaatttctggtaagcttgagctactttaatttttattctatgaaactgatatcccttgatgtgggaaacaggcaggaaaggctgtggggtgggggtgggggactggtgtggcaccgtgcaaacaaaatgacaaatttcaactcacaatctttgtaagaaaattgttccagtttgaatcttgatattaaagtttatgtttacaaaactgccagttagatgaactaagtgtgtaaaacaaatagaaaagacattcgcagacatttcttctatgttattgaatgtgttgtttctggtgtacgtgtcaaaagtttcagttttttagatcagaaataaacgacaaatagtgtgagatgtgttgtgaacaggcatggtgaccgtggtcagcgccactcttgtttcctgaaatgtgcttctaagacagaaaatgtattttctcatcaagggtgtctggagacacagaccgtgaccttggcgcagcggtgtgcatcagaggcgtgtgctgagaagggtggtgttaagctgtggaaaatgactcaagagcaataaatcagtgccaaagcttccctgcgcatctgaatagacacaagtgaagcccgtgtgcgcacagtgcagaggccgagcctgtatttccaggtagacgtggactttattgactgtgaattcatttacatgtaacttctgacatttcactctgtgcaaataaagaacatgaggata

SEQ ID NO: 142 - DNA, 4649 bp, Homo sapiens
agtcggaagcagtgtaccgggccgtggagcggcggctcctgtacccccggcgcggacctaaaggggctcgggccgctcgggccgggaatggcggcggcggccgagcccggggcccgcgcctggctgggcggcggctccccgcgccccggcagcccggcctgcagccccgtgctgggctcaggaggccgcgcgcgcccggggccggggccggggccgggacccgagcgggcgggcgtcagagccccgggccccgctgccgcgccgggacacagcttccggaaggtgacgctcaccaagcccaccttctgccacctctgctccgacttcatctgggggctggccggcttcctgtgcgacgtctgcaatttcatgtctcatgagaagtgcctgaagcacgtgaggatcccgtgcacgagtgtggcacccagcctggtccgggttcctgtagcccactgcttcggcccccgggggctccacaagcgcaagttctgtgctgtctgccgcaaggtcctggaggcaccggcgctccactgcgaagtgtgtgagctgcacctccacccagactgtgtgcccttcgcctgcagtgactgccgccagtgccaccaggatgggcaccaggatcacgacacccatcaccaccactggcgggaggggaacctgccctcgggagcgcgctgcgaggtctgcaggaagacgtgcggctcctctgacgtgctggccggcgtgcgctgcgagtggtgcggggtccaggcgcactccctctgctccgcggcgctggctcccgagtgtggcttcgggcgtctgcgctccctggtcctgcctcccgcgtgcgtgcgccttctgcccggcggcttcagcaagacgcagagcttccgcatcgtggaggccgcggagccgggcgaggggggcgacggcgccgacgggagcgctgccgtgggtccaggcagagagacacaggcaactccggagtccgggaagcaaacgctgaagatctttgatggcgacgacgcggtgagaagaagccagttccgcctcgtcacggtgtcccgcctggccggtgccgaggaggtgctggaggccgcactgcgggcccaccacatccccgaggaccctggccacctggagctgtgccggctgcccccttcctctcaggcctgtgacgcctgggctgggggcaaggctgggagtgctgtgatctcggaggagggcagaagccccgggtccggcgaggccacgccagaggcctgggtcatccgggctctgccgcgggcccaggaggtcctgaagatctaccctggctggctcaaggtgggcgtggcctacgtgtccgtgcgagtgaccccgaagagcacggcccgctctgtggtgctggaggtcctgccgctgctcggccgccaggccgagagtcccgagagcttccagctggtggaggtggcgatgggctgcaggcacgtccagcggacgatgctgatggacgaacagcccctgctggaccggctacaggacatccggcagatgtctgtgcggcaggtgagccagacgcggttctacgtggcagagagcagggatgtagccccgcacgtctccctgtttgttggcggcctgcctcccggcctgtctcccgaggagtacagcagcctgctgcatgaggccggggctaccaaagccaccgtggtgtccgtgagtcacatctactcctcccaaggcgcggtagtgttggacgttgcctgctttgcggaggccgagcggctgtacatgctgctgaaggacatggctgtgcggggccggctgctcactgccctggtgctccccgacctgctgcacgcgaagctgcccccagacagctgtcccctccttgtgttcgtgaaccccaagagtggaggcctcaagggccgagacctgctctgcagcttccggaagctactgaaccctcatcaggtcttcgacctgaccaacggaggtcctcttcccgggctccacctgttctcccaggtgccctgcttccgggtgctggtgtgtggtggcgatggcactgtgggctgggtgcttggcgccctggaggagacacggtaccgactggcctgcccggagccttctgtggccatcctgcccctgggcacagggaatgaccttggtcgagtcctccgctggggggcgggctacagcggcgaggacccgttctccgtactgctgtctgtggacgaggccgacgccgtgctcatggaccgctggaccatcctgctggatgcccacgaggctggcagtgcagagaacgacacggcagacgcagagccccccaagatcgtgcagatgagtaactactgtggcattggcatcgacgcggagctgagcctggacttccaccaggcacgggaagaggagcctggcaagttcacaagcaggctgcacaacaagggtgtgtacgtgcgggtggggctgcagaagatcagtcactctcggagcctgcacaagcagatccggctgcaggtggagcggcaggaggtggagctgcccagtattgaaggcctcatcttcatcaacatccccagctggggctcgggggccgacctgtggggctccgacagcgacaccaggtttgagaagccacgcatggacgacgggctgctggaggttgtgggcgtgacgggcgtcgtgcacatgggccaggtccagggtgggctgcgctccggaatccggattgcccagggttcctacttccgagtcacgctcctcaaggccaccccggtgcaggtggacggggagccctgggtccaggccccggggcacatgatcatctcagctgctggccctaaggtgcacatgctgaggaaggccaagcagaagccgaggagggccgggaccaccagggatgcccgggcggatgctgcgcctgcccctgagagcgatcctaggtaggggtggctggggcagcccaagggctcgagccatctctgctcccgccagccttgttttcaggtggtctggaggcagctccacgtccacacagtggccggccctgtggtcggacctggctacagccctgaccacagcatcttcccagtgacggagcgggacccgccctcatcccattggtgacacatgttggtgtcacagccctcatcccactggagactggtgtgcgggtggcagtgttaccccgtgtcccgggtgggcgcagggctctggatggtgagccctctgccctgtgggggcctggtcctctcctcaggggtgggcacccatccctctccccactgagccccttgagctggacagtgctggatgcaggccgtccaggtgggtctgatctcactttgtgcccctcgggccgtccccctggccagtccttaagagcagcaggctccctggtgtgtccctgccccagcagacacaggctgccagtccctccagcctcacctccccgccctgggcagcaggtgtgggcagcgtgtgaggctgccgggtggtggtgactggtgacttccttgtgttcagggaagggagaaggtgccttcccttgttttctggccttgttatatacagatggcagcttggatctcaggtacagctccaggggcaggcagtgcccagctggacctggtggccctttcctagtgcctctgcttggggaggagaacctctgtccacgtggaggctaggaggtctcaggtgctgccctggcagcaccagagtgtgggccgggcccgagtgtctgcccctcggccctcagggtggggcacttagcacccagaagggaccaaaagcagggcatggcggtgcagaggagtttgggaggtgtaaacagcccatgcacgtggaggaggagctggctttcagccccagaccccacgctagcactttccacgctgcttgcccgctgttgatgtgcagttcccagtgcctgtgtgagccgacatctgctcagtcctatccctcgtcagcgtgtggagacccagctcctgcagccctcctgctcccacgcccccagacagcttggtggagggtcctgcatctgggccaggctggggtgcacccagccaaagacaaagctgcctccacgtgcccaaggattcagatggtgcactggccccgggaggagtctgaccaaaaatggagcccgctctgtggggaagccccgactcccccacgagaaacggtcccacggtgcggatctcccccttcccttgtggggcacagctggcctgggcctccaatcctgcggagctttcctgggtgtggctttgacctcagaagtggctctggtttggcctcaggagtgtggcctggcccagcctgctgcagcctcctggggggcccttgatgccactaatcccccgaccccccgcatctgccaaactgcacagacacacgcattgtaaggccgcttgtggcctccagcgtgcactcttgtttacgtcattgtcatcttcaagaccagtcctttgtgattagttttgcttcgcgagccctggtgtggactgtggtctgtatgaatcgtgtgtaactgtggtgaggggcttgtcctgtatgtgagtctgtacccaggtggggtctgtgccctgcacaccgggcccctctgtatttatcgctgcctgaatgcaacagtaatttatatccaggacaaatacagtctgggcgtcactatccta

SEQ ID NO: 143 - DNA, 2201 bp, Homo sapiens
cgatccacgcgcgctccacacccggaccctctccaagttggaaaggacaaaaagaaggcaataaatgctaaaaagggagagaaggggagctggatcgagcggcaactcccagcctctgctggaacagagagggagggagggagccggagcgagcgagcgcgcgcgagggcgagcgctgcacgtaaagaaactgacacccggaccccccacttctcctgcacgttgctggcaatcagatcgcgtttaagcaatttcctgagcccaagaatagcaatgagtcgggagactttcgcgggctgaaattgggagctccaagcactttttccccccactttttttttttttttttttctggagacggggtgggggtgggggcgctacaatttggaatcagctttttttttttttttttttttttttttaatcttgcactttgaaaccgcgggaccgaggcagggtgcgcgcgtgtggttggtgcctttttttttttttcttcccctccctaaactcctctgtcagtctgtaaacattacctgagaattccccagccgaaacggctgctggggcaagaaacttcttgttagaactttccacctccggcttccccctccacctcttttaccgtcccaaccttaggagacgctttttctcccccagaggagaatttatcttttttttttttttttttttctttttctcacccggtgctttgcatttgggaagaggtgatttcaagagtggccaggtgggacgcctctctcctccttattcggtttactatttattgttcggggtgttttttaattcctgtattgctcggcccggggagtttcgccccctgcccggctccgcggcgcggaggatggtgtggaaacggctgggcgcgctggtgatgttccctctacagatgatctatctggtggtgaaagcagccgtcggactggtgctgcccgccaagctgcgggacctgtcgcgggagaacgtcctcatcaccggcggcgggagaggcatcgggcgtcagctcgcccgcgagttcgcggagcgcggcgccagaaagattgttctctggggccggactgagaaatgcctgaaggagacgacggaggagatccggcagatgggcactgagtgccattacttcatctgtgatgtgggcaaccgggaggaggtgtaccagacggccaaggccgtccgggagaaggtgggtgacatcaccatcctggtgaacaatgccgccgtggtccatgggaagagcctaatggacagtgatgatgatgccctcctcaagtcccaacacatcaacaccctgggccagttctggaccaccaaggccttcctgccgcgtatgctggagctgcagaatggccacatcgtgtgcctcaactccgtgctggcactgtctgccatccccggtgccatcgactactgcacatccaaagcgtcagccttcgccttcatggagagcctgaccctggggctgctggactgtccgggagtcagcgccaccacagtgctgcccttccacaccagcaccgagatgttccagggcatgagagtcaggtttcccaacctctttcccccactgaagccggagacggtggcccggaggacagtggaagctgtgcagctcaaccaggccctcctcctcctcccatggacaatgcatgccctcgttatcttgaaaagcatacttccacaggctgcactcgaggagatccacaaattctcaggaacctacacctgcatgaacactttcaaagggcggacatagagacaggatgaagacatgcttgaggagccacggagtttgggggccacagcacctgggcacacacccgagcacctgtccattggcatgcttctgctgggtgagcaggacagctcctgtccccagcgaagaatccggctgcccctgggccagtcccaggacctttgcacaggactgatgggtataactgacccccacagggaggcaggaaaacagccagaagccaccttgacacttttgaacatttccagttctgtagagtttattgtcaattgcttctcaagtctaaccagcctcagcagtgtgcatagaccatttccaggagggtctgtccccagatgctctgcctcccgttccaaaacccactcatcctcagcttgcacaaactggttgaacggcaggaatgaaaaataaagagagatggcttttgtga

SEQ ID NO: 144 - DNA, 2076 bp, Homo sapiens
gggcttgggcgccagaggcggagtcggggaggaggtggctccagagatggcagtgagcgagaggagggggctcggccgcgggagccccgcggagtgggggcagcggctacttctggtgctgctgctgggtggctgctccgggcgcatccaccagctggcgctgacgggggagaagcgagcggacatccagctgaacagcttcggtttctacaccaatggctctctggaggtggagttgagcgtcctgcggctgggcctccgggaggcagaagagaagtccctgctggtggggttcagtctcagccgggttcggtctggcagagttcgctcctattcaacccgggatttccaggactgccctctccagaaaaacagtagcagtttcctggtcctgttcctcatcaacaccaaggatctgcaggtccaggtgcggaagtatggagagcagaagacgttgtttatctttcccgggctcctcccggaagcaccctccaaaccagggctcccgaagccacaggccacagtcccccgcaaggtggatggcggagggacctctgcagccagcaagcccaagtcaacacccgcagtgattcagggtcctagtgggaaggacaaggacctggtgttgggcctgagccacctcaacaactcctacaacttcagtttccacgtggtgatcggctctcaggcggaagaaggccagtacagcctgaacttccacaactgcaacaattcagtgccaggaaaggagcatccattcgacatcacggtgatgatccgggagaagaaccccgatggcttcctgtcggcagcggagatgccccttttcaagctctacatggtcatgtccgcctgcttcctggccgctggcatcttctgggtgtccatcctctgcaggaacacgtacagcgtcttcaagatccactggctcatggcggccttggccttcaccaagagcatctctctcctcttccacagcatcaactactacttcatcaacagccagggccaccccatcgaaggccttgccgtcatgtactacatcgcacacctgctgaagggcgccctcctcttcatcaccatcgccctgattggctcaggctgggccttcatcaagtacgtcctgtcggataaggagaagaaggtctttgggatcgtgatccccatgcaggtcctggccaacgtggcctacatcatcatcgagtcccgcgaggaaggcgccagcgactacgtgctgtggaaggagattttgttcctggtggacctcatctgctgtggtgccatcctgttccccgtagtctggtccatccggcatctccaggatgcgtctggcacagacgggaaggtggcagtgaacctggccaagctgaagctgttccggcattactatgtcatggtcatctgctacgtctacttcacccgcatcatcgccatcctgctgcaggtggctgtgccctttcagtggcagtggctgtaccagctcttggtggagggctccaccctggccttcttcgtgctcacgggctacaagttccagcccacaggaaacaacccgtacctgcagctgccccaggaggacgaggaggatgttcagatggagcaagtaatgacggactctgggttccgggaaggcctctccaaagtcaacaaaacagccagcgggcgggaactgttatgatcacctccacatctcagaccaaagggtcgtcctcccccagcatttctcactcctgcccttcttccacagcgtatgtggggaggtggagggggtccatgtggaccaggcgcccagctccccgggaccccggttcccggacaagcccatttggaagaagagtcccttcctccccccaaatattgggcagccctgtccttaccccgggaccacccctcccttccagctatgtgtacaataatgaccaatctgtttggctacgccgttgtcttgcctttttgggggttggggtctacacggaggttgtgtttacaatgtagaaacctgttttcgctgtgtgtggcgggggcgcgggcacagggtccgtgtctttgtatattcaataaatattcattcagtaa

SEQ ID NO: 145 - DNA, 2567 bp, Homo sapiens
aggcgcggggagcctcccccttcgactgcagcctcgctccgtgccttctgcgcgcctgggatcccggagcctgcctaggttctgtgcgctcccgcccaggccggtgcccgccgcccgcctgcgccccaggcaggtcccaggcctccggctgctcccggccgaaggtggggacaggcagtggcaggcaccactagcgagggcgtttgggaacccagggtgaccacggcgcagccatggggaccgcgcttgtgtaccatgaggacatgacggccacccggctgctctgggacgaccccgagtgcgagatcgagcgtcctgagcgcctgaccgcagccctggatcgcctgcggcagcgcggcctggaacagaggtgtctgcggttgtcagcccgcgaggcctcggaagaggagctgggcctggtgcacagcccagagtatgtatccctggtcagggagacccaggtcctaggcaaggaggagctgcaggcgctgtccggacagttcgacgccatctacttccacccgagtacctttcactgcgcgcggctggccgcaggggctggactgcagctggtggacgctgtgctcactggagctgtgcaaaatgggcttgccctggtgaggcctcccgggcaccatggccagagggcggctgccaacgggttctgtgtgttcaacaacgtggccatagcagctgcacatgccaagcagaaacacgggctacacaggatcctcgtcgtggactgggatgtgcaccatggccaggggatccagtatctctttgaggatgaccccagcgtcctttacttctcctggcaccgctatgagcatgggcgcttctggcctttcctgcgagagtcagatgcagacgcagtggggcggggacagggcctcggcttcactgtcaacctgccctggaaccaggttgggatgggaaacgctgactacgtggctgccttcctgcacctgctgctcccactggcctttgagtttgaccctgagctggtgctggtctcggcaggatttgactcagccatcggggaccctgaggggcaaatgcaggccacgccagagtgcttcgcccacctcacacagctgctgcaggtgctggccggcggccgggtctgtgccgtgctggagggcggctaccacctggagtcactggcggagtcagtgtgcatgacagtacagacgctgctgggtgacccggccccacccctgtcagggccaatggcgccatgtcagagtgccctagagtccatccagagtgcccgtgctgcccaggccccgcactggaagagcctccagcagcaagatgtgaccgctgtgccgatgagccccagcagccactccccagaggggaggcctccacctctgctgcctgggggtccagtgtgtaaggcagctgcatctgcaccgagctccctcctggaccagccgtgcctctgccccgcaccctctgtccgcaccgctgttgccctgacaacgccggatatcacattggttctgccccctgacgtcatccaacaggaagcgtcagccctgagggaggagacagaagcctgggccaggccacacgagtccctggcccgggaggaggccctcactgcacttgggaagctcctgtacctcttagatgggatgctggatgggcaggtgaacagtggtatagcagccactccagcctctgctgcagcagccaccctggatgtggctgttcggagaggcctgtcccacggagcccagaggctgctgtgcgtggccctgggacagctggaccggcctccagacctcgcccatgacgggaggagtctgtggctgaacatcaggggcaaggaggcggctgccctatccatgttccatgtctccacgccactgccagtgatgaccggtggtttcctgagctgcatcttgggcttggtgctgcccctggcctatggcttccagcctgacctggtgctggtggcgctggggcctggccatggcctgcagggcccccacgctgcactcctggctgcaatgcttcgggggctggcagggggccgagtcctggccctcctggaggagaactccacaccccagctagcagggatcctggcccgggtgctgaatggagaggcacctcctagcctaggcccttcctctgtggcctccccagaggacgtccaggccctgatgtacctgagagggcagctggagcctcagtggaagatgttgcagtgccatcctcacctggtggcttgaaatcggccaaggtgggagcatttacaccgcagaaatgacaccgcacgccagcgccccgcggccgcgatccggaccccaagcccacggctccctcgactctggggcacggaaccccgcccactcccaatccccgcgccccgccctctcccacccgtgcttcccccgctccacccctcacctcacctcgcccccgccccacccatcgcgccccggcccgtcccatcgaggcccatgcaacccacgctcggtcccgttccggcccctgcgccccgctgcgcttcgctccccgcccttgcgccgttagtaaacatcgctcaaacgaaa

SEQ ID NO: 146 - DNA, 3379 bp, Homo sapiens
gtcggggaaaggcggggtctcggccggcgctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctatttcagagccacagtgggctccacagaggtgagtgtggccgtgaccccagatggttacgcggatgccgtgagaggggatcgcttcatgatgccagctgagcgccgcctgcccctgagcttcgtgctggatgtgctggagggccgggcccagcaccctggagtcctctatgtgcagaagcagtgctccaacctgcccagcgagctgccccagctgctgcctgatctggaatcccatgtgccctgggcctccgaagccctgggaaagatgcccgatgctgtgaacttctggctgggggaggcggctgcagtgacttctttgcacaaggaccactatgagaacctctactgcgtggtctcaggagagaagcatttcctgttccatccgcccagcgaccggcccttcatcccctatgagctgtacacgccggcaacctaccagctaactgaagagggcacctttaaggtggtggatgaagaggccatggagaaggcagaggtgtccaggacctgcctgctcacggttcgtgtcctgcaggcccatcgcctaccctctaaggacctagtgaccccctctgactgctacgtgactctctggctgcccacggcctgcagccacaggctccagacacgcacggtcaagaacagcagtagccctgtctggaaccagagctttcacttcaggatccacaggcagctcaagaatgtcatggaactgaaagtctttgaccaggacctggtgaccggagatgaccctgtgttgtcagtactgtttgatgcggggactctgcgggctggggagttccggcgcgagagcttctcactgagccctcagggtgaggggcgcctggaagttgaatttcgcctgcagagtctggctgaccgtggcgagtggctcgtcagcaatggcgttctggtggcccgggagctctcctgcttgcacgttcaactggaggagacaggagaccagaagtcctcagagcacagagttcagcttgtggttcctgggtcctgtgagggtccgcaggaggcctctgtgggcactggcaccttccgcttccactgcccagcctgctgggagcaggagctgagtattcgcctgcaggatgcccccgaggagcaactaaaggcgccactgagtgccctgccctctggtcaagtggtgaggcttgtcttccccacgtcccaggagcccctgatgagagtggagctgaaaaaagaagcaggactgagggagctggccgtgcgactgggcttcgggccctgtgcagaggagcaggccttcctgagcaggaggaagcaggtggtggccgcggccttgaggcaggccctgcagctggacggagacctgcaggaggatgagatcccagtggtagctattatggccactggtggtgggatccgggcaatgacttccctgtatgggcagctggctggcctgaaggagctgggcctcttggattgcgtctcctacatcaccggggcctcgggctccacctgggccttggccaacctttatgaggacccagagtggtctcagaaggacctggcagggcccactgagttgctgaagacccaggtgaccaagaacaagctgggtgtgctggcccccagccagctgcagcggtaccggcaggagctggccgagcgtgcccgcttgggctacccaagctgcttcaccaacctgtgggccctcatcaacgaggcgctgctgcatgatgagccccatgatcacaagctctcagatcaacgggaggccctgagtcatggccagaaccctctgcccatctactgtgccctcaacaccaaagggcagagcctgaccacttttgaatttggggagtggtgcgagttctctccctacgaggtcggcttccccaagtacggggccttcatcccctctgagctctttggctccgagttctttatggggcagctgatgaagaggcttcctgagtcccgcatctgcttcttagaaggtatctggagcaacctgtatgcagccaacctccaggacagcttatactgggcctcagagcccagccagttctgggaccgctgggtcaggaaccaggccaacctggacaaggagcaggtcccccttctgaagatagaagaaccaccctcaacagccggcaggatagctgagtttttcaccgatcttctgacgtggcgtccactggcccaggccacacataatttcctgcgtggcctccatttccacaaagactactttcagcatcctcacttctccacatggaaagctaccactctggatgggctccccaaccagctgacaccctcggagccccacctgtgcctgctggatgttggctacctcatcaataccagctgcctgcccctcctgcagcccactcgggacgtggacctcatcctgtcattggactacaacctccacggagccttccagcagttgcagctcctgggccggttctgccaggagcaggggatcccgttcccacccatctcgcccagccccgaagagcagctccagcctcgggagtgccacaccttctccgaccccacctgccccggagcccctgcggtgctgcactttcctctggtcagcgactccttccgggagtactcggcccctggggtccggcggacacccgaggaggcggcagctggggaggtgaacctgtcttcatcggactctccctaccactacacgaaggtgacctacagccaggaggacgtggacaagctgctgcacctgacacattacaatgtctgcaacaaccaggagcagctgctggaggctctgcgccaggcagtgcagcggaggcggcagcgcaggccccactgatggccggggcccctgccacccctaactctcattcattccctggctgctgagttgcaggtgggaactgtcatcacgcagtgcttcagagcctcgggctcaggtggcacggtcccagggtccaggctgagggctgggagctcccttgcgcctcagcagtttgcagtggggtaaggaggccaagcccatttgtgtaatcacccaaaaccccccggcctgtgcctgttttcccttctgcgctaccttgagtagttggagcacttgatacatcacagactcatacaaatgtgaaaaaaaaaaaaa

SEQ ID NO: 147 - DNA, 1173 bp, Homo sapiens
gatccaccctcaatctaccagaatcatgggctgctgtggctgctccggaggctgtggctccggctgtgggggttgtggctccggctgtgggggctgtggctccggctgtgggggctatggctctggctgtgggggctgtggctccagctgctgtgtgcccgtctgctgctgcaagcccgtgtgctgctgtgtgccagcctgttcctgctccagctgtggctcctgtgggggctccaagggggactgtggctcttgtgggggctccaaagggggctgtggttcctgtgggggctccaaggggggctgtggctcctgtgggggctccaaggggggctgtggttcttgtgggggctccaaggggggctgtggctcctgtgggggctccaaaggtggctgtggttcctgtgggggctccaaggggggctgtggttcttgtggctgctcccagtgcaattgctgtaagccctgctgctgctcctcaggctgtggatcctgctgccagtccagctgctgcaatccctgctgctgccagtccagctgctgtgtccccgtgtgctgccagtctagctgctgcaagccctgctgctgtcagtccagctgctgtgtccccgtgtgctgccagtgtaagatctgaggctctgaacccagaccttcaggtttcacctgtttggtgaaagcatttgttatgatttccctgaattaattcatcccacgcatcctccctgaggcacctgccccttctccagctcatcatccatgcacgcacctccttccatggctcagctctccactgggccctgccttcagcctcctcactccggaaatgcatgtttccttgatgcaggaggtggccttgcctggacgcgggcacccagccaactgccatggtgttccctgcacttgggtgtggaccatcttcttcttctccctcggctgactgagatgcaaggtctgaccccacaaggccaggccaatgttgctcagtgatcactaagaaccagcttctcaaccaccattgggaccctggatcctccagggccgctcgctgcctgttctccagtggccacctgtgaccaggaaggtctccttccttcctgttgtctccatctatttaaaaacaataacaaagtaatgaatgaatttccttacaataaagcctctcatgtctgtaaa

SEQ ID NO: 148 - DNA, 3098 bp, Homo sapiens
acacactccgcggactcacacccgcgcgcacacacgcagaggccgctcgccttcctgcctggcttccttcctgtctgctccgcgcctgacaggcccctcgccgcagccaggggccgcccgcaccgggccgaggccgggccgggccggcggcgagcgcagcgggggccgcgggcggcggcggcggctcatgcccggcctgtccccgcgaggggcgggcaccgtgactcggctgggcccccagaggcgggcgatgtgaagatgtcagtgggctgtgcctgtcctggttgttcctcaaagtcattcaagctgtactcgccgaaggagcccccgaacggcaacgcctttccccccttccatcccggcaccatgctggatagggatgtgggcccaactcccatgtatccgcctacatacctggagccagggattgggaggcacacaccatatggcaaccaaactgactacagaatatttgagcttaacaaacggcttcagaactggacagaggagtgtgacaatctctggtgggatgcattcacgactgagttctttgaggatgatgccatgttgaccatcactttctgcctggaggatggaccaaagagatataccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtgtgtgtggagggccggttgtacctggagttcatgtttgacgacatgatgcggataaagacgtggcacttcagcatccggcagcaccgagagctcatcccccgcagcatccttgccatgcatgcccaagacccccagatgttggatcagctctccaaaaacatcactcggtgtgggctgtccaattccactctcaactacctccgactctgtgtgatactcgagcccatgcaagagctcatgtcacgccacaagacctacagcctcagcccccgcgactgcctcaagacctgccttttccagaagtggcagcgcatggtagcaccccctgcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggttgtctatacccacagcccttagggacttaaagttacggggcttcgttgaatgctccttcccctaggcagctggtaatagaggggtaaagctctgggcccctcctccctgctgccacttatcccagctccaagtttttttaaaaataatattattaaaaatgtaagttaaaaaaaaaatcactcatgtccccccctcttccccctattaaaagtccagctacctccctactcttggcagatgggggcctagggcctaggtgggggtgagagtgggggagggaggtgtgcataccattttatatggtgtgagagcttcagaccaaggagacatttcaccatctctccccctttcctctggggtgactgcagttgaggaaagcatgccatggggtagggggacattggtggccacattttggtgacagacccctgctgttgtctctgtgtccccattctctggactctggcctgccctcctagtgcttgtgactccctctcttccagccccacccccatggtatgtatattccttacaagtcctccacaagagcagctgtctaggatgcggggaggggaggctccttcccttagggagcgtggagagaagggagcagccttgttgctgtatttttggttttgtttcagttgggcaggcatgggatgggagaggggctcagccactttcctccagaatcttccctcagcccctccaactgcatatgtaatcctactctgtccttcatagaggggaaggagccacagatgacatcccagttctaagcccaccagggaggaacaggcctctgtccccataggtgaggtagaggtagagggtcttcacctgccagtatcccctgccgctccttcctcacagaaggaaggaggaggaggcagccgggatcctcggctctgccagggtgcagccaggagcagggtttcacgcagctggtccagctctgtggctttgctgccttttcctgtggccagtcccaggaagtgctaacaccacctctctccccactcttccctctggattctggggtcccccacaccgtatttcctccactccagctgccacttttggaagggtattgagtcaggagctgagggaaggggtgaggaaggtggacatcccatcccaactgtaatgcctttttttttttttttttttttttttttttttttttttttttttgggccatttgagtcatgtatggtaccaatcaataaagagacttttcggtttga

SEQ ID NO: 149 - DNA, 2165 bp, Homo sapiens
agagcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggcctttatcgtcctctttctcctctggccctttgcctggcttcaagtggccggtcttagtgaggagcagcttcaggagccaattacaggatggaggaagactgtgtgccacaacggggtgctaggcctgagccgcctgctgtttttcctgctgggcttcctccggattcgcgttcgtggccagcgagcctctcgccttcaagcccctgtccttgttgctgccccacactccactttctttgaccccattgttctgctgccctgtgacctgcccaaagttgtgtcccgagctgagaacctttccgttcctgtcattggagcccttcttcgattcaaccaagccatcctggtatcccggcatgacccggcttctcgacgcagagtggtggaggaggtccgaaggcgggccacctcaggaggcaagtggccgcaggtgctattctttcctgagggcacctgttccaacaagaaggctttgcttaagttcaaaccaggagccttcatcgcaggggtgcctgtgcagcctgtcctcatccgctaccccaacagtctggacaccaccagctgggcatggaggggtcctggagtactcaaagtcctctggctcacagcctctcagccctgcagcattgtggatgtggagttccttcctgtgtatcaccccagccctgaggagagcagggaccccaccctctatgccaacaatgttcagagggtcatggcacaggctctgggcattccagccaccgaatgtgagtttgtagggagcttacctgtgattgtggtgggccggctgaaggtggcgttggaaccacagctctgggaactgggaaaagtgcttcggaaggctgggctgtccgctggctatgtggacgctggggcagagccaggccggagtcgaatgatcagccaggaagagtttgccaggcagctacagctctctgatcctcagacggtggctggtgcctttggctacttccagcaggataccaagggtttggtggacttccgagatgtggcccttgcactagcagctctggatgggggcaggagcctggaagagctaactcgtctggcctttgagctctttgctgaagagcaagcagagggtcccaaccgcctgctgtacaaagacggcttcagcaccatcctgcacctgctgctgggttcaccccaccctgctgccacagctttgcatgctgagctgtgccaggcaggatccagccaaggcctctccctctgtcagttccagaacttctccctccatgacccactctatgggaaactcttcagcacctacctgcgccccccacacacctctcgaggcacctcccagacaccaaatgcctcatccccaggcaaccccactgctctggccaatgggactgtgcaagcacccaagcagaagggagactgagtgcctcagcctctcaccccctcctcctcagggcagcgctaggggcctcccctatgcctcagccccatctctgctcctgtttgaattttgttattgttgtttggttgttgtttttttaagttgattttaattttttgtttggttgatttttttgtaaaaaactattttatatataaatataaatctatatctatatctattaaaaaaaatgaagtccagtcatattgatgttaccattacttgggaaggaaagggatgaatggttgtaggacgcccgttggaaaatcacaaatgtttccaaggttcgtcctcttggccatagctggatgaatcttcctcttcggacagggctctttcctgcacagaaatcatactgaggttccatatcctccctcctgctgtcatctcctatatgtacattttaacagacttcctcgtgaacctcttttcagcccattccctcttgctctgtcctcattaaagattaaaaaata

SEQ ID NO: 150 - DNA, 2062 bp, Homo sapiens
aaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatcctggctgggacgcgcatggatttaggagaatgtaccaaaatccacgacttggccctccgagcagattatgagattgcaagtaaagaaagagacctgttttttgaattagatgcaatggatcacttggagtcctttattgctgaatgtgatcggagaactgagctcgccaagaagcggctggcagaaacacaggaggaaatcagtgcggaagtttctgcaaaggcagaaaaagtacatgagttaaatgaagaaataggaaaactccttgctaaagccgaacagctaggggctgaaggtaatgtggatgaatcccagaagattcttatggaagtggaaaaagttcgtgcgaagaaaaaagaagctgaggaagaatacagaaattccatgcctgcatccagttttcagcagcaaaagctgcgtgtctgcgaggtctgttcagcctaccttggtctccatgacaatgaccgtcgcctggcagaccacttcggtggcaagttacacttggggttcattcagatccgagagaagcttgatcagttgaggaaaactgtcgctgaaaagcaggagaagagaaatcaggatcgcttgaggaggagagaggagagggaacgggaggagcgtctgagcaggaggtcgggatcaagaaccagagatcgcaggaggtcacgctcccgggatcggcgtcggaggcggtcaagatctacctcccgagagcgacggaaattgtcccggtcccggtcccgagatagacatcggcgccaccgcagccgttcccggagccacagccggggacatcgtcgggcttcccgggaccgaagtgcgaaatacaagtaactactctgactccttcggtagctgcaaccaggagtgagcccttctctgtgttcccagggtctgctgagggccgtgtctggtggggatggggctgggctcaccctcaggagtagggctggggagtcgtgaacgggactcaggtgtgggaagaggcgagagggctgtggaggagctcgcacggcgccaggtgatgggctgcacaggcactgtcccctgcctgcgtcctggggcctgtgcactgttgcgtccatgctcagagtggctgagacttgtgtcctgaccaggccctgcttacctctgttttggtttttgtttttgatatttttttttccattgtgtttttacgtagtgtcatgttctgtgcatatagtgttgtattctcctttgcactgtttatgttacagtgaaggctctccttattaaaaatcttcgcaaaggtcactttttaatggctatctaacactccatatgtggtgggcaagtctggttggcctccggggggtttccaggtataggggatgtagggccttgcctggcctggtctgcgggtccatcgtcagtgcctgagcggccagcagaaggggggcagcagcctccactgagcctctggttcccatttcccaggttctccagagagcgggcatccagagaggagtcctgggagagcgggcggagcgagcgagggcccccggactggaggcttgagagctccaacgggaagatggcttcacggaggtcagaagagaaggaggccggcgagatctgaacccgtctcccgggtgctgtaaatagtctgataaacgttcacacagtctaaaattaccctttatatttgctgaatacaactcatcttttgtagtttaaaatttctattgttttggagctagctgtgagtttctagaagtgtacagagttgctcctgtgttcccgggtcatgttgagtaggaataaataaatctgatgctgcctcctga

SEQ ID NO: 151 - DNA, 4202 bp, Homo sapiens
ccctggcccccatggcgcatgcgcgggaggccgctcggtgatccgcggcggcggcagcggcgcttcctgctaggaccggccggggccgtaccggaggctcgggctccaccgaccctcctcccaccccctcccactcaccctctgggccgcgactgcgcagggcggggccggccgaaccatgggccgcggtgtgggctaagctggtggccccggctttagactggaccccacaatgtttgcagagatgttcaggcacgcgggagctgattacacacaatgaatgggggcaatgagagcagtggagcagacagagctgggggccctgtggccacatctgtccccatcggctggcagcgctgtgtgcgagagggtgctgtgctctacatcagtccaagtggcacagagctgtcttccttggagcaaacccggagctacctcctcagcgatgggacctgcaagtgcggtctggagtgtccacttaatgtccccaaggttttcaactttgaccctttggccccggtgaccccgggtggggctggggtggggccagcatcagaggaggacatgaccaagctgtgcaaccaccggcggaaagctgttgctatggcaactctgtaccgcagcatggagaccacctgctcacactcttctcctggagagggagcgagcccccaaatgttccacactgtgtccccagggcccccctctgcccgccctccctgtcgagttcctcctacaactccacttaatgggggtcctggctcccttcccccagaaccaccctcagtttcccaggcctttcccactctagcaggccctggggggcttttccccccaaggcttgctgacccagtcccttctgggggcagtagcagcccccgtttcctcccaaggggcaatgccccctctccagccccacctcctccacctgctatcagcctcaatgctccctcatacaactggggagctgccctcagatccagcctggtgccctctgacctgggctctcctccggcccctcatgcctcctcctcaccaccttcagaccctcctctcttccactgtagtgatgccttaacaccccctcccctgcccccgagcaataatctccccgcccaccctggtcctgcctctcagccaccagtgtcttcagccactatgcacctgcccctggtcctggggcccctgggaggggcccccacggtggaggggcctggggcaccccccttccttgctagcagcctactctctgcagcggccaaggcacagcatcccccactaccccctcccagcactttacagggccgaaggccccgtgcccaggcaccctcagcttcccactcctcatcacttcgtccctctcagcgtcgtccccgcagaccccctactgtatttcgattgctagaagggagaggccctcaaacccctagacggagccgtcctcgggcccctgctcctgtcccccaacccttttctctcccggagccatcccaaccaattctcccttctgtgctgtccctgctgggactccccacccctggcccttcccactctgatggaagctttaaccttttggggtcagatgcacaccttcctcctcccccaaccctctcctcagggagccctccccagcccaggcaccccatccagccctccctgcctgggaccaccagtggcagcctcagcagtgtgccaggtgcccctgccccaccagctgcctccaaagccccagtagtccccagccctgtgcttcaaagcccatccgaaggactggggatgggggcaggcccggcctgccctctgcctcccctggctggtggagaggctttccctttccccagccctgagcagggcctggcactgagtggagctggcttccctgggatgcttggggccttgcctctccctctgagtctggggcagcctccaccttctccattgctcaaccacagtttatttggtgtgctgactgggggaggaggacaacctccccctgagcccctgctacccccaccaggaggacctggtcctcccctagccccaggagagcctgaagggccttcgcttttggtggcttccttgcttcctccaccaccctcagaccttcttccacctccttcagcacctcccagcaacctccttgcctctttcctgcccctgttggctctgggccccacagctggggatggggagggatctgcagagggagccgggggtccaagtggggagccattttcaggcttgggagacctgtcccccctacttttccccccactttcagccccccctaccctcatagctttaaattctgcgctgctggctgccaccctggatcccccctcggggacacccccccagccctgtgtcctgagtgccccccaacctggaccacctacctccagtgtcaccacggcaactactgacccgggggcctcctctctgggcaaggccccctccaactcagggagacccccccaactccttagccctctgctgggtgccagcctgctgggtgacctgtcttcactgaccagcagccctggagccctccccagcctgttgcagcctcctggccctcttctctctggccagttggggctgcagctcctccctggggggggagctcctccacccctctcagaggcttctagtcccctagcctgcctgctacagagtctccagatccctccagagcagccagaagccccctgtctaccccccgagagccctgcctcagccctcgaaccagagcctgccaggcctcccctcagtgccttagccccaccccatggttctcccgaccccccagtccctgagctgctcactgggagggggtcagggaaacggggccggaggggaggagggggacttaggggcattaatggtgaggccaggccagcccggggccgaaagcctggcagccggcgggagcctggccgactggccctcaaatgggggacacgtggtggcttcaatggacaaatggaaaggtccccaagaagaacccaccattggcagcataatggggagctggctgaagggggtgctgagcccaaggatccaccccctcccgggccccattctgaggaccttaaggtgcccccgggagtagtcagaaagtctcgtcgtggccgtaggagaaaatacaaccctacccggaacagcaatagctcccgccaggacattaccttggaacccagccctacagcccgagcagctgtccctctgcctccccgggcccgccctggccgtcctgccaaaaacaagaggaggaaactggccccatagcagccatacctggagctggatctgaccctgattggggagagctgagtgctgagccttgggagcccctgccagccacctgcacctgtggacagtgggtgggggcactactccccactcagagcacaaatgcaactccttcccctacaatcccatcctgagccattgcagggggcagggaagttcacccccccccaccacccccccgcccccccgaagccatgtcactgaaaaggcctgggggggatggtatatggccctttccccaccaggcgctaaggggaacacccccttccccaggtcttttatttgtttaagttatttttgcacaaatgactcttttatatttaattcgatttcattgcctcccttcttaaagccaacaggctcagtttacaaacctgtgagctactgttggctgctgccctccttcccagtgaaaggtacaaagcaataagcatcatgcatcctccccttacccctccaacacccctctgcctctggctcaggttgctcaaagcacagatcctctcttaccccgtccccaggtttgaaacacatagcctcatttcaaggtgtagccaggttcccccgactttcctctgggatataaaaaagggggtaagggggcaaagagagccctctgggcctctcctcccatacacactacactgccccttctccccccatcaaaacgctcagagacgttgtgatgatgcgactgaggattatgcaacgtggtccaaccggagcggccagcatgaccagctgtccaggggctgcctcctgccttttcttttgtaaagacaagacccttgggagttttaattctgttttgtacttgccctgtggggcctccactgcttttctatgggagacactcttaatttaacagatgagaatattttgaaactctg

SEQ ID NO: 152 - DNA, 740 bp, Homo sapiens
ataaagatctgtgaccggcagccccagacctgcctgccttcctgacttctgttccagagcaaaggtcattcagccgcttgaatcagccttttccccccacccggtccccaactttgtttacccgataaggaaggtcagcattcaaagtcaagaagcgccatttatcttcccgtgcgctctacaaatagttccgtgagaaagatggccgggaactcgatcctgctggctgctgtctctattctctcggcctgtcagcaaagttattttgctttgcaagttggaaaggcaagattaaaatacaaagttacgcccccagcagtcactgggtcaccagagtttgagagagtatttcgggcacaacaaaactgtgtggagttttatcctatattcataattacattgtggatggctgggtggtatttcaaccaagtttttgctacttgtctgggtctggtgtacatatatggccgtcacctatacttctggggatattcagaagctgctaaaaaacggatcaccggtttccgactgagtctggggattttggccttgttgaccctcctaggtgccctgggaattgcaaacagctttctggatgaatatctggacctcaatattgccaagaaactgaggcggcaattctaactttttctcttccctttaatacttgcagaagctgttcccaccatgaaggtaatatggtatcatttgttaaataaaaataaagtctttattctgtt

SEQ ID NO: 153 - DNA, 1758 bp, Homo sapiens
cggctcctctcagcggcggtggcccaggtagaggggtccgcgctggcggcggcggcggcgctgttccccgcgcggtccgcggagcggggtccgggctgcgcgacgtggggcggcggcggcactgcggccccggcccaagcccgaccccgggtcccctcctcggccgccccccgcccggccgcccgccctcgggcctccccccgggccctcggtcccctcccccgctggcggggcccggacagaagatggtgcagaagaaaccagccgaacttcagggtttccaccgttcgttcaaggggcagaaccccttcgagctggccttctccctagaccagcccgaccacggagactctgactttggcctgcagtgctcagcccgccctgacatgcccgccagccagcccattgacatcccggacgccaagaagaggggcaagaagaagaagcgcggccgggccaccgacagcttctcgggcaggtttgaagacgtctaccagctgcaggaagatgtgctgggggagggcgctcatgcccgagtgcagacctgcatcaacctgatcaccagccaggagtacgccgtcaagatcattgagaagcagccaggccacattcggagcagggttttcagggaggtggagatgctgtaccagtgccagggacacaggaacgtcctagagctgattgagttcttcgaggaggaggaccgcttctacctggtgtttgagaagatgcggggaggctccatcctgagccacatccacaagcgccggcacttcaacgagctggaggccagcgtggtggtgcaggacgtggccagcgccttggactttctgcataacaaaggcatcgcccacagggacctaaagccggaaaacatcctctgtgagcaccccaaccaggtctcccccgtgaagatctgtgacttcgacctgggcagcggcatcaaactcaacggggactgctcccctatctccaccccggagctgctcactccgtgcggctcggcggagtacatggccccggaggtagtggaggccttcagcgaggaggctagcatctacgacaagcgctgcgacctgtggagcctgggcgtcatcttgtatatcctactcagcggctacccgcccttcgtgggccgctgtggcagcgactgcggctgggaccgcggcgaggcctgccctgcctgccagaacatgctgtttgagagcatccaggagggcaagtacgagttccccgacaaggactgggcccacatctcctgcgctgccaaagacctcatctccaagctgctggtccgtgacgccaagcagaggctgagtgccgcccaagtcctgcagcacccctgggttcaggggtgcgccccggagaacaccttgcccactcccatggtcctgcagaggtgggacagtcacttcctcctccctccccacccctgtcgcatccacgtgcgacctggaggactggtcagaaccgttactgtgaatgagtgaagatcctggaggaccctgggccccaggccagctcccatcgctgggggacggtgaacggccatgtgttaatgttacgatgtttttaaaagacaaaaaaaaaaaaaaaacctcaaaagtttttttaaagtgggggaaaaacatccaagcactttaattccaatgtaccaggtgaactgacggagctcagaagttttcctttacaccaactgtcaatgccggaattttgtattctgttttgtaaagatttaataaaagtcaaaaaacttgc

SEQ ID NO: 154 - DNA, 2879 bp, Homo sapiens
aggcagcctcaactcagccccaagccactgctctcccatcccagtccctggaaatccacccacttggcccagctcaccccaactccaacccactgggacccagtctccaggggcctgactgtgggcggcagccactcctgagtgagcaaaggttcctccgcggtgctctcccgtccagagccctgctgatggggaagtccgaaggcccagtggggatggtggagagcgccggccgtgcagggcagaagcgcccggggttcctggagggggggctgctgctgctgctgctgctggtgaccgctgccctggtggccttgggtgtcctctacgccgaccgcagagggaagcagctgccacgccttgctagccggctgtgcttcttacaggaggagaggacctttgtaaaacgaaaaccccgagggatcccagaggcccaagaggtgagcgaggtctgcaccacccctggctgcgtgatagcagctgccaggatcctccagaacatggacccgaccacggaaccgtgtgacgacttctaccagtttgcatgcggaggctggctgcggcgccacgtgatccctgagaccaactcaagatacagcatctttgacgtcctccgcgacgagctggaggtcatcctcaaagcggtgctggagaattcgactgccaaggaccggccggctgtggagaaggccaggacgctgtaccgctcctgcatgaaccagagtgtgatagagaagcgaggctctcagcccctgctggacatcttggaggtggtgggaggctggccggtggcgatggacaggtggaacgagaccgtaggactcgagtgggagctggagcggcagctggcgctgatgaactcacagttcaacaggcgcgtcctcatcgacctcttcatctggaacgacgaccagaactccagccggcacatcatctacatagaccagcccaccttgggcatgccctcccgagagtactacttcaacggcggcagcaaccggaaggtgcgggaagcctacctgcagttcatggtgtcagtggccacgttgctgcgggaggatgcaaacctgcccagggacagctgcctggtgcaggaggacatggtgcaggtgctggagctggagacacagctggccaaggccacggtaccccaggaggagagacacgacgtcatcgccttgtaccaccggatgggactggaggagctgcaaagccagtttggcctgaagggatttaactggactctgttcatacaaactgtgctatcctctgtcaaaatcaagctgctgccagatgaggaagtggtggtctatggcatcccctacctgcagaaccttgaaaacatcatcgacacctactcagccaggaccatacagaactacctggtctggcgcctggtgctggaccgcattggtagcctaagccagagattcaaggacacacgagtgaactaccgcaaggcgctgtttggcacaatggtggaggaggtgcgctggcgtgaatgtgtgggctacgtcaacagcaacatggagaacgccgtgggctccctctacgtcagggaggcgttccctggagacagcaagagcatggtcagagaactcattgacaaggtgcggacagtgtttgtggagacgctggacgagctgggctggatggacgaggagtccaagaagaaggcgcaggagaaggccatgagcatccgggagcagatcgggcaccctgactacatcctggaggagatgaacaggcgcctggacgaggagtactccaatctgaacttctcagaggacctgtactttgagaacagtctgcagaacctcaaggtgggcgcccagcggagcctcaggaagcttcgggaaaaggtggacccaaatctctggatcatcggggcggcggtggtcaatgcgttctactccccaaaccgaaaccagattgtattccctgccgggatcctccagccccccttcttcagcaaggagcagccacaggccttgaactttggaggcattgggatggtgatcgggcacgagatcacgcacggctttgacgacaatggccggaacttcgacaagaatggcaacatgatggattggtggagtaacttctccacccagcacttccgggagcagtcagagtgcatgatctaccagtacggcaactactcctgggacctggcagacgaacagaacgtgaacggattcaacacccttggggaaaacattgctgacaacggaggggtgcggcaagcctataaggcctacctcaagtggatggcagagggtggcaaggaccagcagctgcccggcctggatctcacccatgagcagctcttcttcatcaactatgcccaggtgtggtgcgggtcctaccggcccgagttcgccatccaatccatcaagacagacgtccacagtcccctgaagtacagggtactggggtcgctgcagaacctggccgccttcgcagacacgttccactgtgcccggggcacccccatgcaccccaaggagcgatgccgcgtgtggtagccaaggccctgccgcgctgtgcggcccacgcccacccgctgctcggaggcatctgtgcgaaggtgcagctagcggcgacccagtgtacgtcccgccccggccaaccatgccaagcctgcctgccaggcctctgcgcctggcctagggtgcagccacctgcctgacacccagggatgagcagtgtccagtgcagtacctggaccggagccccctccacagacacccgcggggctcagtgcccccgtcacagctctgtagagacaatcaactgtgtcctgcccaccctccaaggtgcattgtcttccagtatctacagcttcagacttgagctaagtaaatgcttcaaagaaa

SEQ ID NO: 155 - DNA, 2679 bp, Homo sapiens
aacccggaaggtccggcgtcccagccgcctacctcgctgggaccctggtcttgctgtcccccgctggcctcctgcccaagcgactgcggccaggatgggccggaaggtgaccgtggccacctgcgcactcaaccagtgggccctggacttcgagggcaatttgcaaagaattttaaagagtattgaaattgccaaaaacagaggagcaagatacaggcttggaccagagctggaaatatgcggctacggatgttgggatcattattacgagtcggacaccctcttgcactcgtttcaagtcctagcggcccttgtggagtctcccgtcactcaggacatcatctgcgacgtggggatgcctgtaatgcaccgaaacgtccgctacaactgcagagtgatattcctcaacaggaagatcctgctcatcagacccaagatggccttggccaatgaaggcaactaccgcgagctgcgctggttcaccccgtggtcgaggagtcggcacacagaggagtactttctgcctcggatgatacaggacctgacaaagcaggaaaccgtacccttcggagatgcggtgctggtgacatgggacacctgcattggaagtgagatctgtgaggagctctggacaccccacagcccgcacatcgacatgggcctggatggcgtggagatcatcaccaacgcctcgggcagccaccaagtgctgcgcaaagccaacaccagggtggatctcgtgactatggtcaccagcaagaacggtgggatttacttgctggccaaccagaagggttgtgacggggaccgcctgtactacgacggctgtgccatgattgccatgaacggaagcgtctttgctcaaggatcccagttttctctggatgacgtggaagtcctgacggccacgctggatctggaggacgtccggagctacagggcggagatttcatctcgaaacctggcggccagcagggcgagcccctaccccagagtgaaggtggactttgccctctcgtgccacgaggacttgctggcacccatctctgagcccatcgagtggaaataccacagccctgaggaggagataagccttggacctgcctgctggctctgggattttttaagacgaagtcaacaggcagggtttttgctgcccttgagtggcggggtggacagcgcagccaccgcctgcctcatctactccatgtgctgccaggtctgcgaggccgtgaggagtggaaatgaggaagtgctggctgatgtccgcaccatcgtgaaccagatcagctacaccccccaggatccccgagacctctgtggacgcatactgaccacctgctacatggccagcaagaactcctcccaggagacgtgcacccgggccagagagttggcccagcagattggaagccaccacatcagtctcaacatcgatccagccgtgaaggccgtcatgggcatcttcagcctggtgacggggaagagccctctgtttgcagctcatggaggaagcagcagggaaaacctggcgctgcaaaatgtgcaggctcgaatacggatggtcctcgcctatctgtttgctcagttgagcctctggtctcggggtgtccacggtgggctcctcgtgctgggatccgccaacgtggatgagagtctcctgggctacctgaccaagtacgactgctccagtgcggacatcaaccccataggcgggatcagcaagacggacctcagggccttcgtccagttctgcatccagcgcttccagcttcctgccctgcagagcatcctgttggcgccggccaccgcagagctggagcccttggctgatggacaggtgtcccagaccgacgaggaagatatggggatgacatatgcggagctctcggtctatgggaaactcaggaaggtggccaagatggggccctacagcatgttctgcaaactcctcggcatgtggagacacatctgcaccccgagacaggtcgctgacaaagtgaagcggtttttctccaagtactccatgaacagacacaagatgaccacgctcacacccgcgtaccacgccgagaactacagccctgaggacaacaggtttgatctgcgaccatttctgtacaacacaagctggccttggcagtttcggtgcatagaaaatcaggtgctacagctcgagagggcagagccacagtccctggacggcgtggactgaggccggttccttcctggaggcctcctgtcctcggggaccccagcacctcatcatcagcattgctggagccaagggtaggagccctacactaggagcccaggatgggacggcgcatcagccgagagggagggaacttttcagtcaaattcctcaaaaagaggctggaataaagcctgggcttaaaaagaggctggaatccaatgcacatgattttgacctcccgccagcgtgcgcttccccgcgaagtctggcattctccgaaggaagccgcctgggtaggagggttccaaccgccgccccgtgtggcatctttgctgcaggaacaagaacagtagctcccgggaagggaggggtgtcatgagcagaaaatgaaggagagaagaccttctctcccacccacacacaccttcctgtcctgggttccagaaggttctggggagatggtccctgcagagctttcttcc

SEQ ID NO: 156 - DNA, 1008 bp, Homo sapiens
atgctaggatccaaaccaagagttcatttgtatattttgccctgtgcctctcaacaggtttctaccatgggtgacaggggaacaagcaatcactcagaaatgactgacttcattcttgcaggcttcagggtacgcccagagctccacattctcctcttcctgctatttttgtttgtttatgccatgatccttctagggaatgttgggatgatgaccattattatgactgatcctcggctgaacacaccaatgtattttttcctaggcaatctctccttcattgatcttttctattcatctgttattgaacccaaggctatgatcaacttctggtctgaaaacaagtctatctcctttgcaggctgtgtggcccagctctttctctttgccctcctcattgtgactgagggatttctcctggcggccatggcttatgaccgctttattgccatctgcaaccctctgctctactctgttcaaatgtccacacgtctgtgtactcagttggtggctggttcctatttttgtggctgcattagctcagttattcagactagcatgacatttactttatctttttgcgcttctcgggctgttgaccacttttactgtgattctcgcccacttcagagactgtcttgttctgatctctttatccatagaatgatatctttttccttatcatgtattattatcttgcctactatcatagtcattatagtatcttacatgtatattgtgtccacagttctaaagatacattctactgagggacataagaaggccttctccacctgcagctctcacctgggagttgtgagtgtgctgtatggtgctgtcttttttatgtatctcactcctgacagatttcctgagctgagtaaagtggcatccttatgttactccctagtcactcccatgttgaatcctttgatttactctctgaggaacaaagatgtccaagaggctctaaaaaaatttctagagaagaaaaatattattctttga

SEQ ID NO: 157 - DNA, 2058 bp, Homo sapiens
gacaatcgcggccaccgccaggtggaacggcaggtgggttcaggtaccagcctggccgggacccggctgtgggaccaacgcttccggtgagcgacagaggcagctccccagggcctggagacccgtggggcggactctgggatctgagcctatcgccctggcctggagcccccctttgtacctattccccattcccctaccgagctgggcagttagccagcccactccaactctcggaaccatgtttgcagacttggattatgacatcgaagaggataaactcggaatcccgactgtgcctgggaaggtgaccctgcagaaggatgctcagaacctgatcgggatcagcattggaggaggggcccagtactgtccctgcctctatatcgtccaggtatttgacaacaccccagcagccttggacggcacagtggcagctggcgatgagatcaccggtgtcaatggcaggtcaatcaaagggaaaactaaggtggaggtggcgaagatgattcaggaggtgaagggggaggtgaccatccactacaacaagctgcaggcggaccccaagcagggcatgtccctggacattgtgttgaagaaagtcaagcaccggctggtggagaacatgagttcagggaccgcagatgctctgggcctgagccgggccatcctgtgcaatgatgggcttgtcaagaggctagaggagctggagcggaccgctgagctatacaaagggatgacggaacacaccaagaacctcctacgggccttttatgagctgtcgcagactcaccgggcctttggggacgtgttctccgtgatcggggtgcgggagccccagccagctgcgagcgaggcttttgtgaagttcgccgatgcccaccgcagcatcgagaagttcggcattcggcttctgaaaaccatcaagccgatgctgacggatctgaacacgtacctcaacaaagccatcccggacactcgcctcaccatcaagaagtacctggacgtgaagtttgagtacctgtcgtactgcctgaaggtgaaggagatggatgacgaggaatacagctgcattgccctaggcgagcccctttaccgggtgagcaccggcaactatgagtaccgcctgatcctgcgctgccgccaggaggcgcgcgcccgcttctcccagatgcgcaaggatgtgctggagaagatggagctgctggaccagaagcacgtccaggacatcgtgttccagctgcagcgcctcgtgtccaccatgtccaagtactacaacgactgctacgcagtgctgcgggatgccgacgtcttccccatcgaggtagacctggcgcacaccacattggcctatggcctcaaccaggaggagttcacagatggggaggaggaggaggaggaggaagacacggcagctggggagccgtccagggatacacgaggggctgctgggcccttggacaagggtggaagctggtgtgactcctgagtgccccgcggctgtggtgccgggggcagggtgcgtgggaggacggagcctgggagcggggcggggccgccgcgcaagggggcgacgcataaaggcctgctggcttggggcgcctgcctccctgctcctctgtcctcgcacagcgaacctgggctcctgcccaggacaggcaccagggtcatggcctgggacctggacactggcccctccaccctccctcccctcccggctccccggccagagggagagcttggtctctggacctgccttaggaaggagagggagggcaggaaggaaaagaaaggacttggaggtggcaggagtccgagccctgctccttgtgggcgctcacactgcccccggagcctgctgggagtggggccagccgtggacagctgaggttggggtcaatgcctcctgggcacccttgcctcgccccagaccggcccgtccagtccccatcacacctcggcggcctttatttattctgttcccccagctcggccacttctctgaaggagggctgggttctgggcctgtatcgaataaacacaaacctggatggcgca

SEQ ID NO: 158 - DNA, 3980 bp, Homo sapiens
aggccgctcggaaccgtggcggcggcggaggcggggatcccgcggctgcggcgacggtggccgcggtggagccacggggcgggcttggcttggtgtgacggcggctgcggcggcggtggcggccgcgaccaggtcggcgtcctcagctggccgagcatggtggcagcctgcacccttggctcccttgtctggtgcagccagcagagccgccagccttgggcgcccatggccctccgtgtgagggcgtgagcggcctgccccagcctcacctgctgatggaggactcaatggcccagtgacctgacaccacaccaccaactccctcccaccagctgacgaatggtggacccagtgacgagtggcccttgtaagggtcatggaataatttgaagcgaggcatgagcggcccctgtggtcgcctgtgactgctggagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcaggcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggcctcacactccccgacttgcccgagcagttctccccacctgatgtggctccccctcttctggtgaagcttgtggaggccattgaaaggacagggctggacagcgaatctcactaccgcccggagctgcccgcaccgcgtacagactggtccctgagcgacgtggatcagtgggacacggcagccctggctgacggcattaagagcttcctgctggcactgcccgcgccgctcgtgacccccgaggcctcggccgaggcgcgccgggccctgcgggaggccgcggggcccgtggggccggcgctggagccaccgacgctgccgctgcaccgcgcgctcacgctgcgcttcctgctccagcacctgggccgcgtggccagccgcgccccggccctgggtcccgcggtccgggccctgggcgccacctttgggccgctgctgctgcgcgcgccgccgccgccgtcctcgccgccgccagggggcgctcccgacgggagtgagcccagccctgacttcccggcgctgctggtggagaagctgcttcaggaacacttggaagagcaggaggttgcgcccccagcgctgccgcctaaaccccccaaggcaaagccggcctccacagtcctggccaatggagggagcccaccctccctgcaggatgctgagtggtactggggggacatttcaagggaggaggtgaacgagaaactccgggacactcccgatggcaccttcctagtccgagatgcttctagcaagatccagggcgagtacacgctgaccctcaggaaaggcgggaacaataagctgatcaaggtcttccaccgagatgggcactatggcttctcagagccactcaccttctgctccgttgtggacctcatcaatcactaccgccacgagtctctggcccagtacaatgccaagctggacacacggctcctctaccctgtgtccaaataccagcaggaccagattgtcaaggaggacagcgtggaggcagtgggcgcccagcttaaggtctatcaccagcagtaccaggacaagagccgcgagtatgaccagctttatgaagagtacacacggacctcccaggagctgcagatgaagcgtactgcaattgaggccttcaatgagactatcaagatctttgaagagcagggccagactcaagagaaatgcagcaaggaatacctggagcgcttccggcgtgagggcaacgagaaagagatgcaaaggatcctgctgaactccgagcggctcaagtcccgcattgccgagatccatgagagccgcacgaagctggagcagcagctgcgggcccaggcctcggacaacagagagatcgacaagcgcatgaacagcctcaagccggacctcatgcagctgcgcaagatccgagaccagtacctcgtgtggctcacccagaaaggcgcccggcagaagaaaatcaacgagtggctggggattaaaaatgagactgaggaccagtacgcactcatggaggacgaggacgatctcccgcaccacgaggaacgcacttggtacgtgggcaagatcaaccgcacgcaggcagaggagatgctgagtggcaagcgggatggcaccttcctcatccgcgagagcagccagcggggctgctacgcctgctccgtggtagtggacggcgacaccaagcactgcgtcatctaccgcacggccaccggcttcggcttcgcggagccctacaacctgtacgggtcgctgaaggagctggtgctgcactaccagcacgcctcgctggtgcagcacaacgacgcgctcaccgtcaccctggcgcacccagtgcgcgccccgggccccggcccgccgcctgccgcccgctgagcaccgaggacccgccccaagcagagccgcccctgggcccgtctgcgccggaggctgcggcggcgggagccacggaccagaccagccacatccaggggtcctcatttctccggctctggctcttgtttggggttctctcaccctctttctctttccttccctcccccattctccagatctccctctgtctccttttctctgtctttcttggcccctgtctctctccatgttgggggtcctaactcccccaccccatatctacgtgtcctccgggcattgccctctccatggctctggtcaccctgaccctctgccctgcccaccgcaggtcccccggggtcccggaagccccttctggctgcacctgccatgtttacagagggcccctgggctgcgcggccccagcctgggcaccctgatttttaagccatagacctggggtcagggcaggaaggaacttcactctgctgcttccgagaacctcggccgtgacattcggggccgggcgggacccgccccacagactccaacttcccctccaaaccccgaagtgaaacccgccaccgggttacccccacaagggggccgctgcgagaagttcacccacccccgaaaaaataattaaactcgcaggccaggcacggtggctcatgcctgtaatcccagcactttgggaggccaagacgggcggatcttttgaggtcgggagttggaggccagcctggccaaaatggcaaaaccccgcatctactaaaatacaaaaattagccgggcgtggtggcggccgcctgtaatcccagctacttgggaggctgaggcgtgagaatctcttgaacccaggagatggaggttgcagtgagcagagatcgtgccactgcactccagcctgggtaacagagggagactcctccgtctcaaaaaaataaataaataaacttgtgagctggccccaacccctcctaggaatcacagctccccgtactggtgccgccgcagtggccaagttgcgacactgcccacggcccctccctctgatgcagattcagggcttctcttcgatcatgttgggttttgattctgtttttccttgactgcaaaaccctctttcctctcctcttttgggacaagagccctggttttctacgctgcccttggccaccacactgcctgccccacgagctgggaggcaggttttgtacggtacgttgttattgatatgatataaaacatcaaacgtc

SEQ ID NO: 159 - DNA, 3182 bp, Homo sapiens
gagccggcccagctgctcggaggctctggcatgtcggttcccgattctggtccccggcccccagcagcgcctgcccccttcccaccggggccccccatgatgccaccacccttcatgccccctccagggatccccccaccctttcctccgatggggctaccccccatgagtcagagaccaccagctatcccccccatgccacctggcatcctgcccccaatgcttccaccaatgggggcgccaccaccactcacacagataccaggaatggtacctccgatgatgccaggaatgctgatgccagcggtgcctgtcaccgcagcgacggctccgggtgcggacaccgccagctctgctgtggctgggacaggccctccgagggccctatggagtgagcatgtggccccagatgggcgcatctactactacaatgctgacgacaagcagtccgtgtgggagaagcccagcgtgctcaagtccaaggcagagctgctcctgtcccaatgtccctggaaagagtacaagtcggacacaggcaaaccttattactataacaaccagagtaaagagtcccgctggacccggcccaaggatctggatgacctagaggttctagtcaaacaagaggctgcagggaaacagcagcagcagctgccacagacacttcagccacagccacctcagccacagcctgaccccccacctgtgcctcctggccccaccccagtgcccacaggcctcctggaacctgagccaggtgggagtgaagattgtgatgtgttggaggccacccagcccctggaacaggggttcctgcagcagctggaggagggccccagcagttctggacagcatcagccacagcaggaggaggaggaatcaaagccagaaccagagaggtctggcctcagttggagcaaccgggagaaggcaaagcaggcattcaaggaactgctgagggacaaggctgtcccctccaatgcctcatgggaacaggccatgaagatggtggtcaccgacccccgttacagtgccttgcctaaactgagtgagaaaaagcaggcattcaatgcctacaaggcgcagcgggagaaggaggagaaggaggaggcccggctaagggccaaagaggccaagcagaccctgcagcatttcctggagcagcatgaacgcatgacctccaccacccgctaccggcgggcagaacagacctttggggagctggaggtctgggctgtggtccctgagagggatcgaaaagaggtttatgatgatgtcctcttcttcctggccaagaaggagaaggaacaggccaagcagctccggcgccgcaatatccaggccctaaagagcatcctggatgggatgagtagtgtcaacttccaaaccacgtggtcccaggcccagcagtacctcatggataaccccagctttgctcaggaccatcagctgcagaacatggacaaggaagatgcactgatctgttttgaggagcacatccgagctttggagagggaagaggaggaggaacgggagcgggcccggcttcgggagcgacgccaacaacgcaagaatcgggaggccttccagaccttcctggacgagctgcatgagacagggcagctgcactctatgtccacctggatggagctatatccagcagtcagcactgatgtccgctttgccaacatgctgggccagccgggctccacccctctggacttattcaagttctatgtggaggagttgaaggcacgattccatgatgaaaagaagatcattaaggacatccttaaggaccggggcttctgcgtggaggtgaacacggcctttgaggacttcgcccacgtcataagctttgacaagagggctgccgcactggacgcaggcaacatcaagctgaccttcaatagtctgctggagaaagcagaggcacgggagagggagcgggagaaggaggaggcacgcaggatgcggcgcagggaagctgcctttcgaagcatgctgaggcaggctgtgcctgctctggagctaggcactgcctgggaagaggtccgtgagcgttttgtgtgtgactcagcctttgagcagatcaccctggagtcggagcggatccggctcttccgggagttcctacaggtgctggagactgaatgccagcacctccacaccaaaggccgaaagcatggcaggaaaggcaagaagcaccatcacaagcgttcccactcaccctcaggctctgagtcagaagaagaggagctgcccccaccatctctccggccccccaagcggaggaggcggaacccctcagagtcaggctctgagccctcttcctcacttgattcagttgaaagtgggggtgctgcccttggaggacggggctccccttcctcccatcttcttggagcagatcatggccttcggaaagccaagaaaccaaaaaagaaaactaagaagagaagacacaagtcgaatagtcctgagagtgagacagaccctgaggagaaagctggcaaggagagcgatgagaaagaacaagaacaggacaaggacagggagctccaacaggcagagctccctaaccgttccccaggctttggaatcaagaaggagaagacaggctgggacacgtcagaaagtgagctgagtgagggtgagctggagaggcggcggcggacactcctacagcagctggatgatcaccagtgacccaatgagctgttctctgcctcgggtctgtgtgaggccatggctcctgggccaccctcaccgtctgcctcagacttcttccttagtctggtctgtgtccactttttctaaagtaaccccacccccagcacaccattgttggcacctctcaaggttgctcttggtgttcaagggtcccctactccctggactagtgcagtccttgccctcagccccagaccagagatgggtggtatatgccatgtggggtgggtgatgccagtagataaaagtgtgagagaaggggtctccagggaagagtcacaggctgttggacgcagcctgggtggcagagggcagggtcatcaccctctagcatcagtgcctgctcctgcctgccctggccctgaggctccaccacttcttcctccacccaggacctaatgtacgtgtgttttgttttttgttttttaaataacaatatttataacatg

SEQ ID NO: 160 - DNA, 7677 bp, Homo sapiens
gcattcctcgcggcacccgcggacaccaggcaggcccggccgggtgcgcggccaaggcccgctccccgcgtccccgggcgccgcccccgcccgcggctgggctccgagagacgagtgggagagcgagtgcagcgagggcgagaggcgagccgagcaggccgccctgcccgcggccctagcgccggcgcgaggagggggcgccgcggcccaccctccttcctgcctggccgcgggccggccgggccgccgcgccccgacccccatggccacccaggcctccgggccgcgaagtcgcagcgccagacccaaggcccccgagtgagcgcgggcgccgaggatctcatctggccaccgcgttctggaagaggcgagagggagagcgtgcgcgagaggagagagacggcgggggaaagggagacggcgagacgcgcagcgccggcgcccgggagacccaggaggagcccgcagataaccagcccgagtcatgcagtcttttcgagaaaggtgtggtttccatggcaaacaacagaactaccagcagacctcgcaggaaacatcacgcctagagaattacaggcagccgagtcaggccgggctaagctgcgaccggcagcggctgctcgccaaggactattataacccgcagccttacccgagctatgagggtggcgctggcacgccctctggcactgcagccgcggtggccgccgacaagtaccaccgaggcagcaaggccctgcccacacagcaaggcctgcaggggaggccggctttccctggctacggcgtccaggacagcagcccctacccaggccgctatgctggtgaggagagccttcaggcttggggggccccacagccaccacccccacagccgcagccactacctgcaggggtggccaagtatgatgagaacttgatgaaaaagacagcagtgccccccagcaggcagtatgcagagcagggcgcccaggtgccctttcggactcactccctgcacgtccagcagccaccgccgccccagcagcccctggcataccccaagctccaaaggcagaagctgcagaacgacattgcctcccctctgcccttcccccagggtacccactttcctcagcattcccagtccttccccacctcctccacctactcctcctctgtccagggtggtgggcagggggcccactcctataagagttgcacagcaccgactgcccagccccatgacaggccgctgactgccagctccagcctggccccggggcagcgggtccagaatcttcatgcctaccagtcgggccgcctcagctatgaccagcagcagcagcagcagcagcagcagcagcagcagcagcaagcccttcagagccggcaccatgcccaggaaaccctccattaccaaaacctcgccaagtatcagcactacgggcagcaaggccagggctactgccagccggacgcagccgtccggaccccagagcagtactaccagaccttcagccccagctccagccactcacccgcccgctccgtgggccgctcaccttcctacagttccacaccgtcgccgctgatgccaaacctggagaactttccctacagccagcagccgctcagcaccggggccttccccgcagggatcactgaccacagccacttcatgcccctgctcaatccctccccaacggatgccaccagctctgtggacacccaggctggcaactgcaagccccttcagaaggacaagctccctgagaacctgctgtcggatctcagcctgcagagcctcacggcgctgacctcacaggtggagaacatctccaacaccgtccagcagctgctgctctccaaggctgctgtgccgcagaagaaaggtgtcaagaacctcgtgtccaggaccccagagcagcataaaagccagcactgcagccccgaagggagcggctactcagccgagcccgcaggcacaccgctgtcagagccgccgagcagcacgccacagtccacgcatgcggagccgcaggaggccgactacctgagcggctccgaggacccactggagcgcagcttcctctactgcaaccaggcccgtggcagccctgccagggtcaacagcaactcgaaggccaagcccgagtccgtgtccacctgttctgtgacctctcctgacgacatgtccaccaaatctgacgactccttccagagcctacacggcagtctgccgctcgacagcttctccaagttcgtggcgggtgagcgggactgtccgcggctgctgctcagcgccctggcacaggaggacctggcctccgagatcctggggctgcaggaagccatcggtgagaaggccgacaaagcttgggctgaagcacccagcctggtcaaggacagcagcaagccacccttctcgctggagaaccacagcgcctgcctggactctgtggccaagagtgcgtggccccggcctggggagccggaggccctgcccgactccttgcagctggacaagggcggcaatgccaaggacttcagcccagggctgtttgaagacccttccgtggccttcgctacgcctgaccccaaaaagacaactggtcctctctcctttggtaccaagcccacccttggggttcctgctccagaccccactacagcagcttttgactgtttcccggacacaaccgctgccagctcagcggacagcgccaacccctttgcctggccagaggaaaacctgggggatgcttgtcccaggtggggattgcaccctggcgagcttaccaagggcctggagcagggtgggaaggcctcagatggcatcagcaaaggggacacccatgaggcttcggcctgcctgggcttccaggaggaggacccccctggggagaaggtggcctcgttgcccggggacttcaagcaggaggaggtgggtggggtgaaggaggaggcaggtgggctgctgcagtgccccgaggtggccaaggctgaccggtggctggaggacagccggcactgctgttccaccgccgacttcggggacctcccactgctgccacccaccagcaggaaggaggacctggaagctgaggaggagtactcctccctatgtgagctcctgggcagccccgagcagaggcctggcatgcaggacccgctgtcacccaaggccccactcatctgcaccaaggaggaggtggaggaggtgctggactccaaggccggctggggctctccgtgccacctctcaggggagtccgtcatcctgctgggccctacagtgggcaccgagtcaaaggtccagagctggtttgagtcctctctgtcacacatgaagccaggtgaagaggggcctgatggggagcgagctccaggggattccaccacctcggacgcctctctggcccagaagcccaacaagcctgctgtgcccgaggcgcccatcgcaaagaaagagcctgtgccacggggcaaaagcttacggagccgtcgggtgcaccgggggctgcccgaggccgaggactccccatgcagggcaccagtgctgcccaaagacctcttgctccctgaatcctgcacagggcccccccagggacagatggaaggggctggagccccaggccggggggcctcggaagggctccccaggatgtgtactcgttctctcacggccctgagtgagccccgcacgcccggacccccaggcctgaccaccacccctgcacccccagacaaactggggggcaagcagcgagccgccttcaagtcgggcaagcgggtggggaagccctcacccaaggctgcctccagccccagcaacccggccgccctgcctgtggcctccgacagcagcccgatgggctccaagaccaaggagacagactcacccagcacgcctggcaaggaccagcgctccatgatccttcggtcacgcaccaaaacccaggagatcttccactccaagcggcggaggccctctgagggccggctccccaactgccgtgccaccaagaagctcctcgacaacagccacttgcccgccacattcaaggtctccagcagcccccagaaggagggcagggtgagccagcgggcaagggtccccaaacctggtgcaggcagcaagctctctgaccggcccctccatgcgctcaaaaggaagtcggccttcatggcgccggtccccaccaagaagcggaacctggtcttgcggagccgcagcagcagcagcagcaacgccagtggcaatgggggagatgggaaggaggagaggcctgagggttcccccaccctcttcaagaggatgtcttctcccaagaaagccaagcccaccaagggcaatggcgagcctgccacaaagctcccacccccggagacccccgatgcctgcctcaagctcgcctctcgggcagccttccagggggccatgaagaccaaggtgctgccaccccggaagggccggggcctgaagctggaagccatcgtgcagaagatcacctcgcccagcctcaagaagttcgcatgtaaagcgccaggggcctctcctggtaatcctctgagcccatccctttccgacaaagaccgtgggctcaagggtgctgggggcagcccagtgggggtggaagaaggcctggtaaatgtgggcaccgggcagaagctcccaacttctggggctgatccgttatgcagaaatccaaccaacagatccttaaaaggcaaactcatgaacagtaagaaactgtcttctactgactgtttcaaaaccgaggccttcacatccccggaggccctgcagcctggggggactgccctggcgcctaagaagaggagccggaaaggccgggcaggggcccatggactctccaaaggcccgctggagaagcggccctatcttggcccggctctgctcctgactccccgagacagggccagtggcacacaaggggccagtgaggacaactctggtggaggaggcaagaagccaaagatggaggagctgggcctggcctcccagcccccggagggcaggccctgccagccccagacaagggcacagaaacagccaggccacaccaactacagcagctattccaagcggaagcgcctcactcggggccgggccaagaacaccacctcttcaccctgtaaggggcgtgccaagcgacgacgacagcagcaggtgctgcccctggatcccgcagagcctgaaatccgcctcaagtacatttcctcttgcaagcggctgaggtcagacagccggacccccgccttctcacccttcgtgcgggtggagaagcgagacgcgttcaccaccatatgcactgttgtcaactcccctggagatgcgcccaagccccacaggaagccttcctcctctgcctcctcttcctcatcctcgtcctcgttctccttggatgcagccggggcctccctggccacactccctggaggctccatcctgcagccgcggccctccttgcccctctcctccacgatgcacttggggcctgtggtttccaaggccctgagtacctcttgccttgtttgctgcctctgccaaaacccggccaacttcaaggaccttggggacctctgtgggccctactaccctgaacactgcctccccaaaaagaagccaaaactcaaggagaaggtgcggccagaaggcacctgtgaggaggcctcgctgccgcttgagagaacactcaaaggtcccgagtgtgcagctgccgccactgccgggaagccccccaggcctgacggcccagctgacccggccaagcagggcccactgcgcaccagtgcccggggcctgtcccggaggctgcagagctgctactgctgtgatggccgggaggatgggggcgaggaggcagccccagccgacaagggtcgcaaacatgagtgcagcaaggaggctccggcagagcccggcggggaggcccaggagcactgggtgcatgaggcctgtgccgtgtggaccggcggcgtctacctggtggccgggaagctctttgggctgcaggaggccatgaaggtggccgtggacatgatgtgttccagctgccaagaagccggggccaccattgggtgctgccacaaaggatgcctccacacctaccactacccgtgtgccagcgatgcaggttgcatattcatcgaagagaacttttctttgaaatgtcccaaacataagaggctgccgtagtaatccaccccaacggccggaggagccgccggagcccgcctgcccgcccgccgccgaaggagaggagccgcctgcgcagcccccgggcctttgagctgctcccagcgctggtccagagccgatccttgatccgggtcccggatcgtggatccggccgcctagggctcagacttgcggccccgggttgggaggaaaacccgttccggagccgcctgctcccggaaccggacggcacagggcgttcttgcccaccccaggggccaggcttgcggagggggagcccgcggagcggccagactccccggggcgctcagcctccggcgagggtgggagacggctttgtcctggggacactttccctctggaatctcaagacgacgtggcacacattccacgtgggtgctgccgccaccccagtcggtcgtggcgtgcagctgggagccctgggcttgggggtgggggtcgaaacagtactggaagaggcggagggcggctcctagctccgtggactaggcgggggagaaaggaagcctttctgagagcgggctaggccggcactggagaggccggagcctttggaacaaaccgtgcggaacgcgtccaggggccttcccgcccagcctttgccagatctctcgtgcggttcgggcaaagccggggtagacctgggctatgctcagttaggggttgcgggatccccgagtgtgggcgggactgggacaccctttggcctctgtttgtcccctttccagtcctccaccccacccctggagcccagcctgggagcgcaaaacccaagaagcggccagaacgcacctccggctccggcggacgcgcgaccgttgtgcaccaccagggaccgccgcgcctactctgcacgggagcagggacagcgctagatttcgtgtacaaaacctgtgtacccctctatatatatgttacatagaatgtatatatgttgggaacatgctcgcttctcccgtgtgtcgccgccgtgcgtcgtgcgcccgcaacagagccccaaccgggcctttgccgggtaaggggctaccgcgacgccacttgtccacgcagccaccaccggcccgggccagtccctgccagtccgtccgcctgtccgtccgtgtcctcagctctgtccacgcttcgataggcctgacgcagcccccagcccagggccgccctagcaacttcctgtacatatgactgtaaaatggtaaacgtgtgtattatatctggcctcgttatatagtgtatatatatgtatacatatacatatatataatatatatgaagactgtaaatgttaagacgactagtgttcttattagtatattgcttcacactgaagattgtgtgtatcgagctgtttctaaaagatgtttattttccttaagagtaaaaaacagtcattgcattcagaaaaaaaaaaaaaaaaaagtcaataaagatacaacgattgttttggaaaa

SEQ ID NO: 161 - DNA, 2493 bp, Homo sapiens
agagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcaccatccccgcggacgtcaccccggagaaggtgcccacccacatcgtggactactcagaagccgagcagacggacgaggagctgcgggaggagatccacaaggcaaacgtggtgtgtgtggtgtatgacgtctctgaggaggccaccattgagaagattcgaactaagtggatcccactggtgaatggggggaccacgcaggggcccagggtgcccatcatcctagtgggcaacaagtcagacctgcggtcggggagctccatggaggccgtgctccccatcatgagccagtttcccgagattgagacctgcgtggagtgttcggccaagaacctgaggaacatctcagagctgttctactacgcccagaaggccgtcctgcatcccacagcccccctctatgaccctgaggccaagcagttgaggcccgcgtgcgcccaggcgctgacgcgcatcttcaggctctcagatcaggacctggaccaggcgctcagtgacgaagagctcaacgctttccagcagaaatcctgctttgggcaccccctggccccgcaggccctggaggacgtgaagacggtggtgtgcaggaacgtggcgggcggcgtgcgggaggaccggctgaccctggatggtttcctcttcctgaacacgctcttcatccagcgcggccggcacgagaccacctggaccatcctgcggcgcttcggctacagcgatgccctggagctgactgcggactatctctcccctctgatccacgtgccccccggctgcagcacggagctcaaccaccttggctaccagtttgtgcagagagtgtttgagaagcacgaccaggaccgcgacggcgccctctcgcccgtggagctgcaaagccttttcagtgtgttcccagcagcgccctggggccccgagctcccacgcacagtccgcacagaggccggccggttgcccctgcacggatacctctgccagtggaccctggtgacctacctggacgtccggagctgccttggacacctaggctacctgggctaccccaccctctgtgagcaggaccaggcccatgccatcacagtcactcgtgagaagaggctggaccaggagaagggacagacgcagcggagcgtcctcctgtgcaaggtggtaggggcccgtggagtgggcaagtctgccttcctgcaggcctttctcggccgcggcctggggcaccaggacacgagggagcagcctcccggctacgccatcgacacggtgcaggtcaatggacaggagaagtacttgatcctctgtgaggtgggcacagatggtctgctggccacatcgctggacgccacctgtgacgttgcctgcttgatgtttgatggcagtgacccaaagtcctttgcacattgtgccagcgtctacaagcaccattacatggacgggcagaccccctgcctctttgtctcctccaaggccgacctgcccgaaggtgtcgcggtgtctggcccatcaccggccgagttttgccgcaagcaccggctacccgctcccgtgccgttctcctgtgctggcccagccgagcccagcaccaccatcttcacccagctcgccaccatggccgccttcccacatttggtccacgcagagctgcatccctcttccttctggctccgggggctgctgggggttgtcggggccgccgtggccgcagtcctcagcttctcactctacagggtcctggtgaagagccagtgaggcccctggtacccaagccccctcccctgacctgggtgtgcctcgctgctggggctctgcaggggcagcacagctggggtgcaggccaggctgccactccgggaacgcctttgcgccgggactttttgtttctgaaggcagtcgatctgcagcggggccttatgctgccatgcactgccctggctcctgccggacccccagggtgggccgtggcaggtggctgagcaggagctcccaagtgccggccaccgctgtcagggattgcccacccctgggcatcatgtgtgtggggccggggagcacaggtgtgggagctggtgaccccagacccagaattctcagggctctacccccctttcctggtcctaggtggccagtgggtatgaggagggctggaaggcagagctttgggccaaaagcaggcgttggggggtcccccctcaagtttggagccgtttccgtggttgtagcagaggaccggaggttgggttcctgattaaacttcactgtgtgttttctatctcggatcccagtctctgaagacaacttgctttgattcaaccta

SEQ ID NO: 162 - DNA, 1910 bp, Homo sapiens
cttcatctcgcggctgtctgacttcctcccagcacattcctgcactctgccgtgtccacactgccccacagacccagtcctccaagcctgctgccagctccctgcaagcccctcaggttgggccttgccacggtgccagcaggcagccctgggctgggggtaggggactccctacaggcacgcagccctgagacctcagagggccaccccttgagggtggccaggcccccagtggccaacctgagtgctgcctctgccaccagccctgctggcccctggttccgctggccccccagatgcctggctgagacacgccagtggcctcagctgcccacacctcttcccggcccctgaagttggcactgcagcagacagctccctgggcaccaggcagctaacagacacagccgccagcccaaacagcagcggcatgggcagcgccagcccgggtctgagcagcgtatcccccagccacctcctgctgccccccgacacggtgtcgcggacaggcttggagaaggcggcagcgggggcagtgggtctcgagagacgggactggagtcccagtccacccgccacgcccgagcagggcctgtccgccttctacctctcctactttgacatgctgtaccctgaggacagcagctgggcagccaaggcccctggggccagcagtcgggaggagccacctgaggagcctgagcagtgcccggtcattgacagccaagccccagcgggcagcctggacttggtgcccggcgggctgaccttggaggagcactcgctggagcaggtgcagtccatggtggtgggcgaagtgctcaaggacatcgagacggcctgcaagctgctcaacatcaccgcagatcccatggactggagccccagcaatgtgcagaagtggctcctgtggacagagcaccaataccggctgccccccatgggcaaggccttccaggagctggcgggcaaggagctgtgcgccatgtcggaggagcagttccgccagcgctcgcccctgggtggggatgtgctgcacgcccacctggacatctggaagtcagcggcctggatgaaagagcggacttcacctggggcgattcactactgtgcctcgaccagtgaggagagctggaccgacagcgaggtggactcatcatgctccgggcagcccatccacctgtggcagttcctcaaggagttgctactcaagccccacagctatggccgcttcattaggtggctcaacaaggagaagggcatcttcaaaattgaggactcagcccaggtggcccggctgtggggcatccgcaagaaccgtcccgccatgaactacgacaagctgagccgctccatccgccagtattacaagaagggcatcatccggaagccagacatctcccagcgcctcgtctaccagttcgtgcaccccatctgagtgcctggcccagggcctgaaacccgccctcaggggcctctctcctgcctgccctgcctcagccaggccctgagatgggggaaaacgggcagtctgctctgctgctctgaccttccagagcccaaggtcagggaggggcaaccaactgccccagggggatatgggtcctctggggccttcgggaccctggggcaggggtgcttcctcctcaggcccagctgctcccctggaggacagagggagacagggctgctccccaacacctgcctctgaccccagcatttccagagcagagcctacagaagggcagtgactcgacaaaggccacaggcagtccaggcctctctctgctccatccccctgcctcccattctgcaccacacctggcatggtgcagggagacatctgcacccctgagttgggcagccaggagtgcccccgggaatggataataaagatactagagaactga

SEQ ID NO: 163 - DNA, 4369 bp, Homo sapiens
ggacggcgcctgcgtactgaggggggacgcggcccggctggctggctctggcggcggctgggctggggccgcggtggcggcagccgcggcggcgggcggcggttgctcgtgcgcggcggcggcggcgggtcccgcgggcggcggggcgctgacggccgggggcgcggcggctgcggcgggccgggcggcgggcggcgagcgggggaagatggcggagctggggaagaagtactgcgtgtactgcctggccgaggtgagcccgctgcgcttccgctgcaccgagtgccaggacatcgagctgtgccccgagtgcttctcggccggcgccgagatcggccaccaccgccgctaccacggctaccagctggtggacggcgggcgcttcacgctctgggggcccgaggccgagggcggctggaccagtcgcgaggagcagctgctgctggacgccatcgagcagttcggcttcggaaactgggaagatatggctgcccacgttggtgcttcccggactccccaagaggtgatggagcattacgtgagcatgtacatccacgggaacctggggaaggcctgcatccccgacaccatccccaaccgcgtgacagaccacacctgtcccagcggaggccccctctcacccagcctcaccaccccgctgcccccgctggacatctctgtggctgagcagcagcagctgggctacatgccgctgcgggatgattacgagatcgagtatgaccaggatgccgagacgctcatcagcgggctctctgtcaactatgatgacgacgacgtggagatcgagctgaagcgcgcccacgtggacatgtacgtgcggaagctgaaagagagacagcggcggaagaacatcgcccgtgactacaatctggtgccagccttcctggggaaggacaagaaggagaaggaaaaggcgctgaagcgcaagatcaccaaggaggagaaggagctgcgcctgaagctgaggccgctgtaccagttcatgtcatgcaaggagtttgatgacctttttgaaaacatgcacaaagaaaaaatgctccgggccaagatccgagaactgcagcggtaccggcgaaacgggatcaccaagatggaagagtcggcagagtacgaggcagcgcggcataaacgggagaagaggaaggagaacaaaaacctagccggctccaaacggggaaaggaggacggcaaagacagcgagttcgccgccattgagaaccttccaggcttcgagctcctgtcagatcgcgagaaggtgctctgcagctctttaaacttgagtccagcccgctacgtgactgtgaagactattataattaaagaccacctccagaagcggcaaggaatcccctccaaaagccgccttcctagctacctggacaaagtcctaaagaaaaggattttgaatttcctcacagaaagcggctggatctccagggacgcgtcttgaagctgagacgctttgaaagccagggtgatgctcagacagtgtgccagccaaaatgacttgggggaggggagccgcttccccactgttgctcttttttaaacaaattgagttcctttttttaagatagaaattcttttcatggtcctctgaaagaagcaatagtaacaatcttatattggatcatgggggaagcaaatgtgtgtattttaagtgagttcctgcgagtcatacactgcgatgatgctccgcctttacccgttcagttgggagcttattgtgagattggatcatttccttttgagtgttcttctctttggtacaaaagctattgtgggtgacaggagcagtgttttcctgctggacccgcaagccaccagctatttcctggtgacacaagctcttctcaggcggggctgcctgcaggctcccgttttctgagcccacgctgcccacagctgaccccagcgcagccccgggcacgcggcactttacatgggggcagcttgggcccagactcctccgctgtgtagcagatgaggaaaatcaggccagaggacaacaggctggcgttttgttgggaactgaagaggaatctgttgaacacagcgaccagatgaccttccatttcaccggcggcagcagtttcagcgtgcagttcccaaaccccaaagctgaccctgcgccccatttgaatacggccagagcctgctggttcactttgggtagagccgtgcctcttgggcaggctcccatagtgaccacgtccccacgaatgggaaagcacgttagtgggagggacgtaggacacgtgtggaccgccaggccctctcagtccattttccggggctgctcggtgctgctgttaagacgtgagtgcatttcacttggaagaacccattgtacaaagttcaaggctaagagttctgaattctggcgtcagcttcctcaggattttcttcagttgcaagtacctttccactgaaaatatgagcatgcccgcctggctagtaggcatctgtaagagtgtcgccaggcccgcgccagctgaggcctcagactagccaggcaagagccgtctgaccagttggctggcggtggttctggtggagcacgagggagcccgggtggtgccctgagcctcgagctgctctctgtcactgtcttgaatcagactcagaaatggcttcttcccagccctgcctacaagtttttctctggggtcctctttcaaggatgtccacggtaccttcctcctgaaacttgaggaagtcttttgtcttccagctgctcagggttctctggtccaagaccctgctttaaagagagtctttggcgtgctcagactccagcgctccgttcttcaaggaggttgacttgcctctcgggccccgtaggtaccaagagactgtttacctcccagaatgtttgggcttgaagttacattaaagtgaagttatttgaaagaaagaaaacctcatcatttctaaggatgacttaattactgtgccttttcctttctttttacacatcctactgtcccttagggtaaaattttcagcattaaataaaacatttcaaatatattgtatatggctttagttgtaaactatactgcatgctgacagagaagcgctcttttagctaagcccagaacttctcttttgacaataaagtactgagcagtggtatcatgagggccacctccacattgtcccctgcagaataaatgcggatgacagaaagcttatgctgtctaccactgaacagtgatggagatggtgctaagtttttacagttgtcttagccccagtggttctcaaggtggggctcctggcccagcagcagcaacttgtttgttagaatgcagacgcgcaggccccacctggcctcctgaatcaaaatggtgtgcggcagggtgcagcgagctgttttcacgaggcctccaggtgactggatgtaagcttgcttgagaactatgggttttagctattctggtgtctccctgattttctacagcgccaggatcctagtttggtgaggttttaaatttaatcttatttttatataaaatgattgccagacgtactatattaagcttgaagaagcagaagatccctgttaatgtgtatggcccaggccaagagctgtcaaatgaaaaactttgtgctgaagcaggtttttagtatgtatatctttttgatggtatgaagaatttatttaggcttgactgttttaaaacaccataatgaatgtataattaatttatgttaaagtattaaccctttgtcacaaaggaatggtaatgtgattggctgcctgttagcccatcgactattcccgtcacggtagtccttacctctgtcggcagctcagagcctccacatttttatatttaattctcatgataaattagccaccataatcccatggaattaggtcttgttaaaatctagtccgggcgcagtggctcacgcctgtaatcccagcactttgggaggccaaggcgggctgatcacgaggtcaagagatcgagaccatcctggccaacatggtgaaaccctgtctctactaaaaatacaaaaattagctgggtgtggtggtgcatgcctgtagtcccagctacttgggaggctgaggtaggagaattgcttgaacctgggaggcggaggttgcggtgagctgagatcacgccactacactccagcctggtgacagagcaagactccatctcaaaaaaaatctaagcaaactatctttgagtcaaaaaaagttggataactcatctatatttgaaataatgctgtctgaatggccaacatcccaagaatgtattaaaaacagcaaccctgcctaccgttttgatgacctttttccatattaaacaagttgagaacaaaa

SEQ ID NO: 164 - DNA, 3627 bp, Homo sapiens
gcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgagagagccttctccatggacgaccgcattgcctggacccacatcaccatcccggagtccctgaggcagggcaaggtggaggacaagtggtacagcctgagcgggaggcagggggacgacaaggagggcatgatcaacctcgtcatgtcctacgcgctgcttccagctgccatggtgatgccaccccagcccgtggtcctgatgccaacagtgtaccagcagggcgttggctatgtgcccatcacagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacccaggacagaccacaagccacactcagaggcctcactgtgctgggggcttcggtgtccaggcgcccaggtgtggccaccagcaccggtttctgccttcgcgttgctggggtgcagtgagactgccacacgcgtgcacatgtggctctgtgggtgtctcctagagaggacgtggcccctgctgccagcccttgagcagcccgtgtgggggcccgagggacccacacagtgggggccagcctcgctggagggagagcaaccctttgccgatgaccacgcttgccgccatctcttagttttctttttcacaagcgctttatttttttaatagacaaatcacattttgcaaggcctttaattaaataagattcttctttccttcattttatgctttatttcctgtttgaaggcttactgtagaagtggcttactgtagaagcagcttgctgagcccctccgagcggtccccagaattagctggttcacaacccccaccctcccccgcccccgcctgtgtcaggtgtggatgaggtcgtcacactcagaaggacaggcttgtctgccagctcacaaggggaggctgcagtgggtttgggagctgggtttaggcccctggtgtctgagggcccaggccttgccagcctctgctgctcctgctcctgggtttgaagatgcaggccgatcgccagctccgtggcagcggtcactaaggacagcctgactgtgccatcttggagcctcaggcggggctccggagatagaagacaggtcgccggaggctccccctcctctcctctcccctctgcagatgctccctgggcgctaccctgcagggtgccaggcaggagtggtctcagaacgtgcgcttctgattattttactggggtccattgtccagatttttctttgattgtaaaatatatttttactttttagtcttctaatttaataaatgatccatataaaaatagagaaataaagtcctttaagggaaggttta

SEQ ID NO: 165 - DNA, 2317 bp, Homo sapiens
gccccgtccgttgagggcccgcgccgcatggaggccggctgaggagcgccgctgcctcgcctcggctccccacaggtgcaggaagccgccgcccagccatggacggggaggagcagcagccaccgcacgaggccaacgtggaacctgttgtgccgtcagaggcttcagagccggtgcccagggtgctttctggagacccccagaacctgtccgacgtggacgccttcaacctgctcctggagatgaagctgaagcggcggcgtcagcggcccaacctgccgcgcactgtgacccagttggtggctgaggacgggagcagggtgtacgtggtggggacagcccacttcagcgacgacagcaagagggacgttgtgaagaccatccgggaggtgcagcctgacgtggtggtcgtggagctctgccaatatcgtgtgtccatgctgaagatggacgagagcacgctgctgcgggaggcccaggagctcagcctggagaagctgcagcaggccgtgaggcagaacgggctcatgtcggggctgatgcagatgctgctgctgaaggtgtctgcacacatcaccgagcagctgggcatggccccaggtggcgagttcagggaggccttcaaggagcctctgctccaggccagcaaggtgcctttctgcaagttccacctgggtgaccgacccatccccgtcaccttcaagagggccatcgcagcgctctccttctggcagaaggtcaggctggcttggggcctgtgcttcctgtcagaccccatcagcaaggatgacgtggaacgctgcaagcagaaggacctactggagcagatgatggccgagatgattggcgagttcccagacctgcaccgcaccatcgtctcggagcgcgacgtctacctaacctacatgctgcgccaggccgcgcggcgcctcgagctgcctcgggcctctgacgccgagcccaggaagtgcgtcccctccgtggtcgtgggcgtcgtgggcatgggccacgtgcctggcatcgagaagaactggagcaccgacctcaacatccaggagatcatgaccgtgcccccgccgtccgtctccggcagagtgtctcggttggccgtgaaggccgccttcttcggcctgctgggctacagcctgtactggatgggccgccgcaccgcgagcctggtcctgtcgctgcccgccgcgcagtactgcctgcagagggtgaccgaggcccggcacaagtaggagactgctccccgcccgctcgggcccctgaggagccagtgcccccgcggcacttctgggtgccaggtgcatcctagcccgcccgaggcccctgccaccccccatgggggtctgggcccggcctcgcctgccctcctgggccagtcacccctcccccagcccacccaaataaaggattatttaactgtctgagctcaggcctcccggcagcccctcccctcccacactgcaggggccgttccccagcttctggacaagacacccagctccgagggggcaggggcttataggaggggccgaggcgtgcgctgccctctcagccctggtggcaggcgggggacaatggccactgtccctacctcactgtgccttcctgtgctccggccacaggagcgtcggcccaggggcggctcctgggggctccagggcaggcgagactgggaaaggcccagccctggagctccagccgaccccaccgtgcccctggcatcctggccctggccgccacctccctggcaccgtctgcctgcagggattctgtgtttttggcttttttaatgtcttaaaatcttttactcaggtaattttaatttcagagagaaaaactgaagtaaatgtcaaaaaacaccagccttaaatccaaagggagagaattcgtgttcttgggtctgtcccgagtgggctcgcgtgcagccaaacatcagctctgggtccaggcgtggcctcagctgggagcctgtgtcctgagcccccggagcgaaggggtgcctggggcatcttggccctctctgggcagacaatgtgtgcacctatgtggaaggccaaggacatgggctgtggccaggcctgtcccgctcaggccccctgcccggcggccgtctgtgtgcggggcctccctcctggctgtccaggacacagcccgtgcagccccagcctggacccaggccatctctggttgtgtctgtgccgactcggtgttgaatcaaatcaggtgtgcgtcaggagccggctgtgtccttcctgccacactcggggattcattccttagaaactgaaataaattctaattttggaaa

SEQ ID NO: 166 - DNA, 5547 bp, Homo sapiens
gaacttgctctaacttcctcggccgagccgggccgcgccgccgctgccgccgccgcgcgcggattctgcttctcagaagatgcactattatagatactctaacgccaaggtcagctgctggtacaagtacctccttttcagctacaacatcatcttctggttggctggagttgtcttccttggagtcgggctgtgggcatggagcgaaaagggtgtgctgtccgacctcaccaaagtgacccggatgcatggaatcgaccctgtggtgctggtcctgatggtgggcgtggtgatgttcaccctggggttcgccggctgcgtgggggctctgcgggagaatatctgcttgctcaactttttctgtggcaccatcgtgctcatcttcttcctggagctggctgtggccgtgctggccttcctgttccaggactgggtgagggaccggttccgggagttcttcgagagcaacatcaagtcctaccgggacgatatcgatctgcaaaacctcatcgactcccttcagaaagctaaccagtgctgtggcgcatatggccctgaagactgggacctcaacgtctacttcaattgcagcggtgccagctacagccgagagaagtgcggggtccccttctcctgctgcgtgccagatcctgcgcaaaaagttgtgaacacacagtgtggatatgatgtcaggattcagctgaagagcaagtgggatgagtccatcttcacgaaaggctgcatccaggcgctggaaagctggctcccgcggaacatttacattgtggctggcgtcttcatcgccatctcgctgttgcagatatttggcatcttcctggcaaggacgctgatctcagacatcgaggcagtgaaggccggccatcacttctgaggagcagagttgagggagccgagctgagccacgctgggaggccagagcctttctctgccatcagccctacgtccagagggagaggagccgacacccccagagccagtgccccatcttaagcatcagcgtgacgtgacctctctgtttctgcttgctggtgctgaagaccaagggtcccccttgttacctgcccaaacttgtgactgcatccctctggagtctacccagagacagagaatgtgtctttatgtgggagtggtgactctgaaagacagagagggctcctgtggctgccaggagggcttgactcagaccccctgcagctcaagcatgtctgcaggacaccctggtcccctctccactggcatccagacatctgctttgggtcatccacatctgtgggtgggccgtgggtagagggacccacaggcgtggacagggcatctctctccatcaagcaaagcagcatgggggcctgcccgtaacgggaggcggacgtggccccgctgggcctctgagtgccagcgcagtctgctgggacatgcacatatcaggggttgtttgcaggatcctcagccatgttcaagtgaagtaagcctgagccagtgcgtggactggtgccacgggagtgccttgtccactgtccccctgtgtccaccagctattctcctggcgccggaactgcctctggtcttgatagcattaagccctgatggcgccggtggcgcggtgggcatggttcttcactgagagccggctctccttttcttaaagtgtgtaaatagtttatttataggggtaagaatgttctcacaccatttcacttcctcttcctctcctccagcattctcctctgagcagccttagatagtgtccatggctggagccgaccctttgagtccccttgagtgtcttaagaaccagcccacaacagcctctctttctcctccacatactgcagcctccctccatgcatcccacatacaagcactcccccactccccagcgtggcctcactgtcttctggtcttggtgctactgaaattgtcacccagaatttgaatcctgaccctccccactgcaagcccagggagccccagcccaagatggccagcctgaaactgttggccagggctcctcttgtggccatgtacccagggctggctggcctgccatttgcctctccccggagacagccgttcttctgcaaccacaccccgtgcctagccacaaccccaggctgcagctgctcagaagctccaggcattttgtttctggtgaccgcccctaatgggatatcggtgatcactggtccacccttcctgtcagggcttttctggggctgctcttggaaatgaagtcttaagtactgaataactcccctggggatagctggggcatttgtctagctgggctactttctaacactttgccatagctcagaccacttctcatcgttcagggatggactgcaaccttaatttacttgccggagtgtacattctagtgtggtgtatactggtggctgttgatgatgatttttttttttttacacaattctctgtagactaggagaagaatgcttgtgtttttcggaagtgtgatgcttctctttgactgccaaactcttttatggaatatatctttatattaatgctgttttggtcatttttgtttggggtcactattgagatattgctaagcatctcagtggtaaacgcggctgccagaggaaccaagggatagggtatgtagaccttacagaaggatggatggtaaaggcagtccatcatcagcacaatctgacttacatttcattgagtaattttttttttttttaagattctgtatggcagcactttcagttgcccttgtgtgccggccacagccgcacaagttggcttgtggtttatcccccgctataagtgagagctggagaaacttcaactccataggtctagaggaaacattgttttaggttatttctgtccacccctgtgcgatactatttattgatccaagcagaagagcttggggacactgagtcgaagtggggacatgggattgaagcctgggcactgctgctgcatgagctgtgtgtcctgggtgtgccggcctttctgtgaagggggttggtggcagtgcccacctcactagatgcctctgacccagcctcccctgggggagtgggtggccacagaccctccctgccagagctcctggaaggctcctgcaggcctgacccatctattcctgtagacctggtttaggatgaagtctcggtgcgatttttgcagagttgggtttatctttcaactatagacccttctggctgttctcagccatatcatgtgactctgaatagttggatgaggaatggaaagaaagcaaggatgagagccggtcacgtggcagtctccgcccagcatcggctgtccgcacagaggcacagggcaggcctcctgtgcactccccacctagcactggcctgtcctgaatccccgccttccctggttggaggccagctgtggcatttgcaccctcttctcacctcaccatgcacatgctaactttaaagccttggggtctttcctgtaccccctcctcaaccctggtccaccccctctcaggatcttgtcaacgttatttttcctgtcccgtcttcctatcgctggccttcctttcccatcctaaaaacttgccgaggccctatggctccctccctttctttcccaggcagcttcttatctgggctgtctgtaccccttcctttgcaccacccaccatgccccacgtagctgaaagctgcttatcccaattgtcaactctggccttcttcagcctctgtagcaccagacactgcacctcctgaatgtcctctgcttctctgcttcagaggcccaggctcgccagttctctgacctctcccatatgtctgcttaggactctgctgcagctgtcctcaccagcctccggggaatcccactacccacagggcagggctgtgggctgggctgaaaaaccatctgcatggtccacaagaagcctggcactgggtttccccatgaataacaatgaaaattaatggatgcacaaccttcctggaacgtggaatttctctgggagattccatgcagaggccactggggaggtggcaggcatgcatgtgactgtaggtggctgcagtgttggaaggctcccagcagagcagagagggtgtcagtctcatcagggaacccacctgatggcttctcagccagcagtctcagaggaacatagacgactgctgagaaaggagggaggcagcagtggtcccagcacctgaggcatcctgctgtcatgggaaggtctccgcccaaatgtcagatgcatcagcctgtcacccgctggtccagagctttcagctgtactggtagggggtgggtggtggagtgctgaatgaccttcacaggtgggcctttccagctctagggtcttacgggtgtcggtccacagaaccacggtttttaggttgtgtgtccggggctatgggaacctgtcccccatgatggatcttggtagagacacttccctctgtcatcgtgcccaggaggatgctgcaggtgactacctgcagccctgttctcattcatttggatgccctccagaaatctggggagccatacacctttagagccttttttgctccttatcaagttggcaaggcttggccaattcctgttcaaggctgcattaaaggcatgttcaccatcctggctaatacggtgaaaccccttctctactaaaaatacaaaaaaattagccgggcttggtggcgggtgcctgtagtcccagctactccggaggctgaggcaggggaatggtgtgaacccaggaggcggagcttgcagtgagccgagatcacaccactgcactccagcctgggctcaaaaaagaaaaaaaaaaaaaaaaaaaggcccgttcattctcaaatgcttttggcgtctccagggtgcctcaggaaaacatgaagtgggcattgtagaacttggggctactgtgtaactttggaagaaaaagttaagggtacttttaagtggatactgttttgatgaaattgccaacttcagggagcccagcttggagaaggaggacgtgagtattccttacaaggctccgaaacaattctttcttcacttagttttctttctgtgctctgcatcttatattccagcagggtcttccaatgcatggtttaataactactagaactggccaggtgcagtggctcacgcctgtaatcccagaactttgggaggctaagacaggcagatcacttgaggccaggagttcgagaccagcctggacaacatggtgatacccagtttctactaaaaatacaaaaattagtcgggcatggtgatgtgcacctgtagtcccagctgctcgggaggctgaggcaggagaatcgcttgaacccgggagacagaggttgcaacgagccaagatcgagccactgcgctccggcctgggtgacaggagactccatctcaaaaaataaaattaaaaaaaaactactacaataaattatcaccttggactgtataaaacaacttttaaactagtctttttaaaaagtacacttaaataaaaatctaaacataagagaatgtaaa

SEQ ID NO: 167 - DNA, 6066 bp, Homo sapiens
acactggcgcggctgtgacgcgacggaggcggcgagagcggcagccgtgggcactttccacgggtgaggcctggagaacgggtggacgtgcaggccagaacccgggacccacccggctgagcccccagactctccgctgcccacgaccctcggagtggcaccctctcctggccgtctcctctcgtgggtcccgaagaacgggtgcaaagccgagttcgtccgctgtactgcgcgggcgcgcgtttcgttcttcggttttgccacggttctgtgactccctaaaggttgagggctactgaattagaagaaacgccgagctggcttctggtgggctgccgggcgccgggcagcgtgcttggactggggagggcagggcgtgtttactctgagtagagcaaccgcaagacctcctttaaaaaataccagttctgagcttcggcattggagaggccgcctgtcattcagcctcttcggaccctctctcactccctgtcttccggagcgtgagtgaagcccgggtgaggtgttttcccacacgccgggggcccggagctgagaaggggcatggccagcatcacgcagctgttcgacgacctgtgtgaggccctcctgccggctgccaagactcacctgggccagcgcagtgtgaaccggaagagggcaaagcggagcctcaagaaggtggcctacaatgctcttttcacaaatctttttcaagatgagactcaacagctgcagcctgacatgtcaaaactaccagcgagaaacaagatcctcatgttgtcctttgacttgagagtgggtggcctgggccccaaggccgaccgtttggaggagcttgtggaggagctggaagcagccccttgctgtccgcttttggaggtggggtctgttttggacctcctggttcagctggcagggagtggtccccctcaagttctgccgagaaaacgagactacttccttaacaacaagcatgtggggagaaacgttccgtacagcggctatgattgcgacgacctgagtgtgtttgagatggacgttcagtctctgatctccagagaagagtgtttgtgtcacagcatgatccaggaaacacttcaggttatggaggctgctccaggcactggcctgcccaccgtcgggctcttctcatttggtgacccttgtggtgacaggttcgagagagacacccgggtctcgctcttcggggcccttgtgcacagccgcacttatgacatggacgtccgactgggcctgccccccgtgccagacaatgcggacctctctgggctggctattaaggtcccaccgagtgtggatcagtgggaagacgaaggattccagtcagcgtccaacttgactcctgattcccagtctgagcccagcgtgaccccagacgtggacctgtgggaagccgcacttacctatgaggccagcaagcggaggtgctgggagcgagttggctgcccccctggccacagagaggagccttacctgacggaggcgggaagggacgctttcgacaagttctgcaggctccaccaaggggagctccagctgcttgctgggggcgtcctacaggccccgcagcccgtgctggtgaaggagtgcgagctggtgaaagacgtgctgaacgtcttgattggggtcgtgtctgccacgttttcgctctgccagccggcccaggcctttgtggtgaagcggggcgtccacgtgtcaggagcgtctcccgagagcatcagcagcctgctctcggaagtggccgagtatgggacctgctacacgcgcctgagtcatttctctctgcagcccgtcctggactctttgtacagcaagggcctcgtgttccaggccttcaccagtggcctgaggaggtacctgcagtattaccgggcctgcgtcctttccactccgcccaccctgagcctcctcaccattggttttctcttcaagaaacttggccggcagctcaggtacctggccgagctctgtggcgttggcgctgtgctcccgggcacctgtggaggaggccccagggccgcgtttcccaccggcgtgaagctgctgtcctacctctaccaggaggctctgcacaactgcagcaacgagcactaccctgtactgctgtccctgctgaagaccagctgcgagccctacacccggttcatccacgactgggtgtacagcggggtgttcagagacgcttatggcgagttcatgattcaggtgaaccacgagtacctcagcttccgagataagttgtactggacacatggctacgtgctcatctccaaagaggtggaggactgtgttcccgtgtttctgaagcacattgcccacgacatatacgtctgcggaaagaccattaacctgctgaagctctgctgcccccggcattacctctgttggtccgacgtccctgtcccccggatctcggtgattttctcccttgaggagttgaaggagattgagaaggactgtgccgtctacgttgggcgcatggagagggtggcccgccacagctctgtcagcaaggaggagaaggaattacgtatggaaattgcaaaacaagaattaatcgctcatgcccgggaagcagcatccagggtcctgagtgcactgagtgaccggcagatgtcagaacggatggccttggatgcccggaagcgtgagcagtttcagaggctgaaagaacaatttgtgaaggaccaggagcgacgccaggcggccaggcaggaggagctggatgatgacttcagctacgcccgtgaactccgagacagggagagaaggctgaagtccctggaggaggagctggagaggaaggcgaggcaggcactggtcgaccactacagcaagctctctgcagaggcagctcgtcgggagcagaaggcactgtggagaatccagaggcaccgactggagagtgcacggcttcgttttctcttagaagatgagaaacacattcaggagatgctgaaagcagtgtctgaggctcaccagccccaggagccgccagacgtcctcttgagcgtgcacccccaggtcacgtctccgggccctgagcacccagagggaggccaaggctgtgattctgggtctgcagagcaacactcgcctgcctgggatggctggaacaggccaggcctgctgaccccacagccccttaagcctctagcagtgggggctggtggcagggggctgcagcaggcggagggggccagacccttctctgacagcctcagcattggagacttcctacctgtgggcccaggggctgagccgtccgtgcagactggcatggtccctctcctggaggtggcgctgcagaccattaacttggacctgcccccctcagctcctggggaggcacccgcagcagccagcactcagccctccaggccacaggagtacgactttagtactgtcctgaggccagctgtggccacctcacctgcaccagggcccctgcaggctgcagagtgcagcttgggcagctcagggctacagctgtgggaggacagttgtgggaagatggatgcctgtggctccgcctcgcgggagactctgctcccctcacacccacccaggcgtgctgctctggaggaggggagcagccagcccacagagcggctctttgggcaggtgtcagggggtggtcttcccacaggggactacgcttctgaaatagctcccacccggccacggtggaacacccacgggcacgtgtctgacgccagcatcagggtcggggagaatgtgtcagatgtggctcccacccagccacggtggaacacccacggacacgtatccaatgccagcatcagcttaggggagtctgtgtcagatgtggctcccactcggccacggtggaacatccatggacatgtgtccaacgccagcatcagggtcggggagaatgtgtcagatgtggctcccaccaggccacggtggaatacccacgggcacgtgtccaacgccagcatcagggttggggagaacgtgtcggacgtggctcccacccggccacggtggaacacccatggacacgtgtccgatgccagcatcagcttgggggagtctgtgtcagacatggctcccgcccggccacggtggaacacccatggacacgtgtctgatgccagcatcagcttgggggagtctgtgtcagacatggctcccacccggccacggtggaacacccacggacatgtgtctgacaccagcatcagggttggggagaacgtatcggacgtggctcccatccggtcacggtgcaacacccatggacacgtgtccgacgccagcatcagcttgggggagcctgtgtcggatgtggtttccacccggccacggtggaacacccatgtacccatccctccgccccacatggtgctgggggctctctcaccagaagctgagcccaacacacccaggccccaacagagcccccctggccacacgtcccagtcagcgctcagcctgggagcacagagcactgtgctggactgtgggccacggctgcctgtagaagtggggccatctctgtcctcccccagctcgggctgcggggaggggagcatcagcgtgggggagaacgtgtcagacgtggctcccacccaaccatggtggcccaacaccccgggagacagtgtctctgaagaactaggccctgggaggagcggggacactgaggacctctctccaaattggcctctcaactcacaggaagacacagctgcccagagcagcccaggccgtggtgaggaggcggaggcatcggcggcggaggctcagggtggggagcaggcctacctggcaggcctggcagggcagtaccacttggagcggtacccggacagttacgagtccatgtccgagccgcccattgctcatcttttgcgccccgtgcttccccgggccttcgccttccccgtggacccccaggtccagtctgccgctgatgagactgctgtgcagctgagcgagttgctgacgctgcccgtgctcatgaagcgctccatcacggcaccgctggccgcccacatctccttggtgaacaaggccgctgtcgactacttcttcgtggagctgcacctggaggcgcactatgaggcactgcggcacttcctgctgatggaggacggcgagttcgcccagtccctcagcgacctgctctttgagaagcttggagctgggcaaacgcccggagagctgctcaacccgctggtgctgaactctgtgctgagcaaggccctgcagtgcagcctgcatggggacaccccgcacgcctccaacctctccctcgctctcaagtacctgcccgaggtgtttgcccccaacgccccggatgtgctgagctgcctggagctcaggtacaaggtggactggcctctcaacattgtcatcaccgagggctgcgtgagcaagtacagcggcgtcttctccttcctgctgcagctgaagctcatgatgtgggcgctcaaggacgtctgcttccacctcaagcgcacagccctgctgagccacatggccggctctgtgcagttccgtcagctgcagctgttcaagcacgagatgcagcatttcgtgaaggtcatccagggctacatcgccaaccagatcctgcacgtcacctggtgcgagttcagggccaggttggccaccgtgggcgacctggaggagatccagcgtgcgcacgcagagtacctgcacaaggccgtcttcaggggcctgctcacggagaaggcggcgcccgtcatgaacgtcatccacagcatcttcagcctcgtgctcaagttccgcagccagctcatctcccaggcctgggggccccctgggggcccgcggggtgcagagcaccccaactttgcactcatgcagcagtcctacaacaccttcaagtactactcccactttctcttcaaagtggtgaccaagctggtgaaccgcggctaccagccccacctggaggactttctgctgcgcatcaacttcaacaactactaccaggacgcctgaggctgctctgcgggggacgtgcacaataaaggtgttctcgga

SEQ ID NO: 168 - DNA, 1917 bp, Homo sapiens
agtagcggctgcacgtcgtgccaatggcccgctatgaggaggtgagcgtgtccggcttcgaggagttccaccgggccgtggaacagcacaatggcaagaccattttcgcctactttacgggttctaaggacgccggggggaaaagctggtgccccgactgcgtgcaggctgaaccagtcgtacgagaggggctgaagcacattagtgaaggatgtgtgttcatctactgccaagtaggagaaaagccttattggaaagatccaaataatgacttcagaaaaaacttgaaagtaacagcagtgcctacactacttaagtatggaacacctcaaaaactggtagaatctgagtgtcttcaggccaacctggtggaaatgttgttctctgaagattaagattttaggatggcaatcatgtcttgatgtcctgatttgttctagtatcaataaactgtatacttgctttgaattcatgttagcaataaatgatgttaaaaaaactggcatgtgtctaaacaatagagtgctattaaaatgcccatgaacctttagtttgcctgtaatacatggatatttttaagatataaagaagtcttcagaaatagcagtaaaggctcaaaggaacgtattcttgaaggtgacggaaatacctaaaaactcctaaaggtgcagagcacaccttccaaatctctcaaaagatcagtatcttttattttaagttatctccatctgcaaagcaactgatgatattcctgaaaccccttctttgattttggaatgtagaacctaacctcaccactgaaggaaagcacatgacctctaatctagcctctgcttaattcaggcagttttgttttgtttaataaaaaacagactcctgagcactagaagcagtttgttttgcagctgtctcaatgtgctttacttgggatgaggcaggtggcggagagcggccggaaagactctataacccagttctgggaagaactccaagctgggagtcagtcacactgactctaccacttactagctgtgtaaccacaggcaagttactcaccccgtccaaacctcagttttctcttctataaacaaggttcttagaataaaatgagaattcaaggaagcacttaacatagcacctggtttgtggtacctcccaaatcaatggtagctttcccaaatgaacacaagtatttgaggctcctcatgtttgttctaaagtcaagagtccagttagtaactaaccactagttgtcctgccatgactaggtcaagtgaggccacagtgattcagtgattcttaaagccaccttgcaaagcaggtaatacagttatttcctgtcctgcagaattcaagaacctttatgcagttcctgtcctatgatttaaagaggtcagtgactccgctactctcactacatcttagagtagagtggtagagtagttgatctgagacagtaaggttccaggagatggtcttgccctactatatgtcaggaacagctagccttagaattcagtatacttggtggcccacccctaccccatgccccagtgccttatttggtctaaagcacctaacttttccattcttaatcagctgattatgctaaatgcgtaaaaaagaaaaacaccttacaaatccacagggaaatcaaagaacaattcaggtttaacagaaatagtctattaacaataaaaagttggatgaaaaagcacactaaaggttctaggggctaccataataaaggtagataggaagagttttcattttttttgtcttcactgtacaaaagaaatacattatatacatgtattaagtgcctcgtttgtatccagtttttcattttcccgatgtgttattttgctgttgctgctctgccaaggcttgctgaaggcgcatccgcttccgggaata

SEQ ID NO: 169 - DNA, 1857 bp, Homo sapiens
gaaaagaatgattgcattgcaccaggatggctctgaagtggacttcagttcttctgctgatacatctcggttgttactttagctctgggagttgtggaaaggtgctggtgtggaccggtgaatacagccattggatgaatatgaagacaatcctgaaagagcttgttcagagaggtcatgaggtgactgtactggcatcttcagcttccattctttttgatcccaatgacgcattcactcttaaactcgaagtttatcctacatctttaactaaaactgaatttgagaatatcatcatgcaacaggttaagagatggtcagacattcaaaaagatagcttttggttatatttttcacaagaacaagaaatcctgtgggaatttcatgacatatttagaaacttctgtaaagatgtagtttcaaataagaaagttatgaaaaaactacaagagtcaagatttgacatcatttttgcagatgctttttttccttgtggtgagctgctggctgcgctacttaacataccgtttgtgtacagtctctgcttcactcctggctacacaattgaaaggcacagtggaggactgattttccctccttcctacatacctgttgttatgtcaaaattaagtgatcaaatgactttcatggagagggtaaaaaacatgatctatgtgctttattttgacttttggttccaaatgtgtgatatgaagaagtgggatcagttttacagtgaagttttaggaagacccactaccttatttgagacaatggggaaagctgacatatggcttatgcgaaactcctggagttttcaatttcctcatccattcttaccaaacattgattttgttggaggactccactgcaaacctgccaaacccctacctaaggaaatggaggaatttgtacagagctctggtgaaaatggtgttgtggtgttttctctggggtcagtgataagtaacatgacagcagaaagggccaacgtaattgcaacagcccttgccaagatcccacaaaaggttctgtggagatttgatgggaataaaccagatgccttaggtctcaatactcggctgtataagtggataccccagaatgaccttctaggtcttccaaaaaccagagcttttataactcatggtggagccaatggcatctatgaggcaatctaccatgggatccctatggtaggcattccattgttttgggatcaacctgataacattgctcacatgaaggccaagggagcagctgttagactggacttccacacaatgtcgagtacagacctgctgaatgcactgaagacagtaattaatgatccttcatataaagagaatgttatgaaattatcaataattcaacatgatcaaccagtaaagcccctgcatcgagcagtcttctggattgaatttgtgatgtgccacaaaggagccaaacaccttcgagttgcagcccgtgacctcacctggttccagtaccactctttggatgtgattgggtttctgctggcctgtgtggcaactgtgatatttgtcgtcacaaagttttgtctgttttgtttctggaagtttgctagaaaagggaagaagggaaaaagagattagttatgtctgacatttgaagctggaaaaccagatagatgggttgacatcagtttattccagcaagaaagaaaagattgttatgcaagatttctttcttcctgtgacaaaaaaaaaaacttttcaaaatctaccttgtcaagtaaaaatttgtttttcagagatttaccacccaggtaatggttagaaatattctgtggcaatgaagaaaacactagggaaaataaaaaataatataaagcca

SEQ ID NO: 170 - DNA, 2348 bp, Homo sapiens
agttccgggctacagcagccgacgccgagaggcaccgtttcttcttaaaagagaaacgctgcgcgcgcgaggtgggcccctgtcttccagcagctccgggcctgctcgctaggcccgggaggcgcaggcgcaggcgcagtgggggtgagggcgcgtgggggcgcacaggtaaggccggggtgggggtgggtcgcgacgggggctctgggcagcctgggaactgccattgggattagtccgctccactcactgtcagcattaagtgggggtgcccaagacggggtggatggggggcgccctccagacctctgaccacggcctcaccgccactcgacccaactatgaagagcgcccccagctgcacgccaggacacgacctttccttcccctagaaaccagtaaaggccgctgccctattcaagatgaaatgtgtggaccgcccccagcccagttgaaatttcccgtgaaagtctctcgccccttccccacagctccacttcagtggactggagggcgcaggcctttgttctgactgcttctgtctgcctgcctcccacccgacgacactcacatgcctctggtgcacatggcttcctccccggcggtggacgtgtcctgcaggcggcgggagaagcggcggcagctggacgcgcgccgcagcaagtgccgcatccgcctgggcggccacatggagcagtggtgcctcctcaaggagcggctgggcttctccctgcactcgcagctcgccaagttcctgttggaccggtacacttcttcaggctgtgtcctctgtgcaggtcctgagcctttgcctccaaaaggtctgcagtatctggtgctcttgtctcatgcccacagccgagagtgcagcctggtgcccgggcttcgggggcctggcggccaagatggggggcttgtgtgggagtgctcagcaggccataccttctcctggggaccctctttgagccctacaccttcagaggcacccaagccagcctcccttccacatactactcggagaagttggtgttccgaggccacgagtgggcaggagcttgcagatttggaatctgagcatgatgagaggactcaagaggccaggttgcccaggagggtgggacccccaccagagaccttcccacctccaggagaggaagagggtgaggaagaagaggacaatgatgaggatgaagaggagatgctcagtgatgccagcttatggacctacagctcctccccagatgatagtgagcctgatgcccccagactactgccttcccctgtcacctgcacacctaaagagggggagacaccaccagcccctgcagcactctccagtcctcttgctgtgccggccttgtcagcatcctcattgagttccagagctcctccacctgcagaagtcagggtgcagccacagctcagcaggacccctcaagcggcccagcagactgaggccctggccagcactgggagtcaggcccagtctgctccaaccccggcctgggatgaggacactgcacaaattggccccaagagaattaggaaagctgccaaaagagagctgatgccttgtgacttccctggctgtggaaggatcttctccaaccggcagtatttgaatcaccacaaaaagtaccagcacatccaccagaagtctttctcctgcccagagccagcctgtgggaagtctttcaactttaagaaacacctgaaggagcacatgaagctgcacagtgacacccgggactacatctgtgagttctgcgcccggtctttccgcactagcagcaaccttgtcatccacagacgtatccacactggagaaaaacccctgcagtgtgagatatgcgggtttacctgccgccagaaggcttccctgaactggcaccagcgcaagcatgcagagacggtggctgccttgcgcttcccctgtgaattctgcggcaagcgctttgagaagccagacagtgttgcagcccaccgtagcaaaagtcacccagccctgcttctagcccctcaagagtcacccagtggtcccctagagccctgtcccagcatctctgcccctgggcctctgggatccagcgaggggtccaggccctctgcatctcctcaggctccaaccctgcttcctcagcaatgagctctcctccagctttggctttgggaagccagactccagggactgaaaaggagcaacaaggagagggtctgcttgagaaatgccagatgcttggtccccaggaactaaggcgacagagtgcagggtgggggcaagactgggctgtaggggagctggactactttagtcttcctaaaggacaaaataaacagtattttatgca

SEQ ID NO: 171 - DNA, 2773 bp, Homo sapiens
gccgcgttttgcctccgcagcagctctgggctcttctcagctgcgcgagcagctgctccaatgccccggagtggccatgggcgccccgcactggtgggaccagctgcaggctggtagctcggaggtggactggtgcgaggacaactacaccatcgtgcctgctatcgccgagttctacaacacgatcagcaatgtcttatttttcattttaccgcccatctgcatgtgcttgtttcgtcagtatgcaacatgcttcaacagtggcatctacttaatctggactcttttggttgtagtgggaattggatccgtctacttccatgcaacccttagtttcttgggtcagatgcttgatgaacttgcagtcctttgggttctgatgtgtgctttggccatgtggttccccagaaggtatctaccaaagatctttcggaatgaccggggtaggttcaaggtggtggtcagtgtcctgtctgcggttacgacgtgcctggcatttgtcaagcctgccatcaacaacatctctctgatgaccctgggagttccttgcactgcactgctcatcgcagagctaaagaggtgtgacaacatgcgtgtgtttaagctgggcctcttctcgggcctctggtggaccctggccctgttctgctggatcagtgaccgagctttctgcgagctgctgtcatccttcaacttcccctacctgcactgcatgtggcacatcctcatctgccttgctgcctacctgggctgtgtatgctttgcctactttgatgctgcctcagagattcctgagcaaggccctgtcatcaagttctggcccaatgagaaatgggccttcattggtgtcccctatgtgtccctcctgtgtgccaacaagaaatcatcagtcaagatcacgtgatggcaagatggtggctggcttctctgcttatcgcccctcatgcagtgggcttcctttgctaggaagacagccaagggagttcgaatagttggggtgtgggctatcttttcaaaaatctatttgctggggctcttaatttctttagtgttctttgtatgtagggatttaaactttgtcatatggtacaaatattccctgcccccctgcagtttcccatttgtctttcagtatgttaatatttttgtgccatactggttttaaactttcatgttgtcacatctgttaatcttttctttaggatttctggattttgtgtaatttttaaaaaggtcccctcctcctccctaatgtgtctgtggaccacctggattccactgtacaaggggaaaagtgtctattcctttcccaaagatggaaaatggagggcttagggacactagatgcatctttctcagcatcacttccagatgcagtgacttgttgggctgcgtccttaatggccatggcagagcagtcccttgggggatccagccctgtacaatgcatctcttcctggagaaagctggcctgctccagaccccaccattcccaggcgcccttggagtggactctactgatgacagacagaccctctgagagacaagaccctctgactctgtgatggaagatgccagagattttcctttggggtaattgtccttaaacaaaaccaaacagatgaaacacacacaggacttgtggctaaaaaggctagtttttcacttgcatttctcaactaacccaggttttacatgcatctgtgaatccttttactactacctctgtggagagatggagagacttcagataaacgtgaagctaatgagtaaaaccctctctgccaaaacctacactccactttaggcccttcttgaagatgagcacaatttttaaatactgagcacaatttttaaatactgacatcacttcctcttccccctcccaccccagctcagcagcctcaaatctacagagaagaagaattatggcatgaacattcccacagacccaccatctttaagacttgacctctgtaagtttaccaaagggctcctcacaattgtggtgggggttctggttcaaaatttggagcaaacatgaagtttttggaaacgttttctcatttgaagcctccagtatgctgtactattctggaaattaccttcaagagtctcacttcttgtttctgttgtgttttctgtgggcatcatgttcttcacgcttgcagtagaaggtgctttctcggtttcccagagtatccaacggctcacctttctcaagtgctggcagtagctatgcactcacgggctggtttgggtcgctggtgcagcagcgcaaatctgttgccttctgaatttttctcacctaatgtgacactggctacaatgaatcttctcttcatcgggctgaatgaaagattcaagaaccatcttcaaggtgcatggtgggaattatcaacctcagggatactcattttaactcaggcgtgtcctgctttgtaacattccattgttgggagagggcaggacaggtgtgttcttctgtgggcaggagtcatgtcactgtcctacatatgtaagagttgggaaggtgacgatttttgacacatccaggaactcttactctagttagaatttgtaccagatccaaggtgaaaaccccaataagcaactgaatttagagtttaaaaatgaatgactttatgctacatctgtggttatcaaattatataggttgttgagaagcagaacgctgtttgtagtaagaaatctttgtggaaccccagtgtgtgaagtaaattgtatgttattaaatttatttaaggttaaa

SEQ ID NO: 172 - DNA, 9314 bp, Homo sapiens
gcaatccagcccgccacgtgtactcgccgccgcctcgggcactgccccaggtcttgctgcagccgggaccgcgctctgcagccgcagacccggtccacacggccaggggctacgacccttgggatctgccctccgctcagctcgagcttccctcgtggccgacggaacaatgaaggattgcagtaacggatgctccgcagagtgtaccggagaaggaggatcaaaagaggtggtggggacttttaaggctaaagacctaatagtcacaccagctaccattttaaaggaaaaaccagaccccaataatctggtttttggaactgtgttcacggatcatatgctgacggtggagtggtcctcagagtttggatgggagaaacctcatatcaagcctcttcagaacctgtcattgcaccctggctcatcagctttgcactatgcagtggaattatttgaaggattgaaggcatttcgaggagtagataataaaattcgactgtttcagccaaacctcaacatggatagaatgtatcgctctgctgtgagggcaactctgccggtatttgacaaagaagagctcttagagtgtattcaacagcttgtgaaattggatcaagaatgggtcccatattcaacatctgctagtctgtatattcgtcctacattcattggaactgagccttctcttggagtcaagaagcctaccaaagccctgctctttgtactcttgagcccagtgggaccttatttttcaagtggaacctttaatccagtgtccctgtgggccaatcccaagtatgtaagagcctggaaaggtggaactggggactgcaagatgggagggaattacggctcatctctttttgcccaatgtgaagcagtagataatgggtgtcagcaggtcctgtggctctatggagaggaccatcagatcactgaagtgggaactatgaatctttttctttactggataaatgaagatggagaagaagaactggcaactcctccactagatggcatcattcttccaggagtgacaaggcggtgcattctggacctggcacatcagtggggtgaatttaaggtgtcagagagatacctcaccatggatgacttgacaacagccctggaggggaacagagtgagagagatgtttggctctggtacagcctgtgttgtttgcccagtttctgatatactgtacaaaggcgagacaatacacattccaactatggagaatggtcctaagctggcaagccgcatcttgagcaaattaactgatatccagtatggaagagaagagagcgactggacaattgtgctatcctgaatggaaaatagaggatacaatggaaaatagaggataccaactgtatgctactgggacagactgttgcatttgaattgtgatagatttctttggctacctgtgcataatgtagtttgtagtatcaatgtgttacaagagtgattgtttcttcatgccagagaaaatgaattgcaatcatcaaatggtgtttcataacttggtagtagtaacttaccttaccttacctagaaaaacattaatgtaagccatataacatgggattttcctcaatgattttagtgcctccttttgtacttcactcagatactaaatagtagtttattctttaatataagttacattctgctcctcaaacaaatgcaattttttgtgtgtgtttgaaagctaatttgagaaaatttcataggttacatttcctgcagcctatctttatccacagaaagtgttttcttttttttaaatcaagacttttaaaactggatttcctcccatcactgttttttgaaggtcctccaagtccgtgttaaggtaaatatctgttttcttcctgatgtcacagcctgagcatactctgtgcattaggaagacctgagtgcatttcccaccattgtcctttccacattatgttgtagctggctggctgtcaggcgactacaagactgagggtcttgtgccttatagatctttgtatcccccatggctgacatatagtaggtactcagtaaatggttttataatgaatcagtgaacattttgcttctatagaagtgtaccttctttgtttctatattatgaaacctctttattagaatttgtgattgattctgacagtgtatagatttaccttatattgtctttattttccatgagctactaagtcattagagatactctgaagcatagttagtttaggaaatcacttcatattgattgtattagaattatcttggaattgaagatatatccctagagcaggggaccccaacccccaggccatgggccacacagcaggaagaggtgagtggtgggccattgaggagcttcatctgtatttatggctacttcccatcactcgaattaccacctgaactccacctcttgtcagctcagtggcagcattagattctcataggagcacaaatcctattgtgaactctgcatgcaagggatctaggctatgcgctccttatgagaatctaatgcttgatgacctgaggtgtaacagtttcatcctgaaaccacccttcaccctgcagtctgtggaaaaattgtcttccacaaaactggtccctggtgccaaaaatgttggggaccactgctctagagagaggtcatgatatcataccaaccaaatggaaatgacaaatgttttatgtcaagtgttaattgcagaaataaatcttttttttttttttttggtagaaaacaaagaggcatactctgatttttatactctgtttttgcaggtgctcttttctttgaatggagatttgatgagcaagtggttaggatgcagggagagctactatgggtgatattttccttgtttaggagctgtgagttaaaattgtatcctttgtggtttatctaaggaaagtcaaatcttgacagaaaacatttttccttggaaggtcaactctcagacattgtattttggtttccctcagtcctcataacttccttcttgctgaacatattttattctcttttcagagaaggaaaataaaaaggattctaaaagtttgatgcattggaaaaatttccttgaggcatttagcaacacatagaaaatgggctttgattcttttccaaaacttttagccatagggtcttttatagacagggatagtaaaatgaaaattgagaaatataagatgaaaaggaatgataaaaatatcttttagggggcttttaattggtgatctgaaatcttgggagaagctgttcttttcaggcctgaggtgctcttgactgtcgcctgcgcactgtgtaccccgagcaacattctaagggtgtgctttcgccttggctaactcctttgacctcattcttcatatagtagtctaggaaaaagttgcaggtaatttaaactgtctagtggtacatagtaactaaatttctattcctatgagaaatgagaattatttatttgccatcaacacattttatactttgcatctccaaatttattgtggcgagacttgtccattgtgaaagttagagaacattatgtttgtatcatttctttcataaaacctcaagagcatttttaagcccttttcatcagacccagtgaaaactaaggatagatgtttaaaaactggaggtctcctgataaggagaacacaatccaccattgtcatttaagtaataagacaggaaattgaccttgacgctttcttgttaaatagatttaacaggaacatctgcacatcttttttccttgtgcactatttgtttaattgcagtggattaatacagcaagagtgccacattataactaggcaattatccattcttcaagacttagttattgtcacactaattgatcgtttaaggcataagatggtctagcattaggaacatgtgaagctaatctgctcaaaaagatcaacaaattaatattgttgctgatatttgcataattggctgcaattatttaatgtttaattgggttgatcaaatgagattcagcaattcacaagtgcattaatataaacagaactggtggcacttaaaatgataatgattaacttatattgcatgttctcttcctttcacttttttcagtttctacatttcagaccgagcttgtcagcttttttgaaaacacatcagtagaaaccaagattttaaaatgaagtgtcaagacaaaggcaaaacctgagcagttcctaaaaagatttgctgttagaaattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgactgagaagtcttgttaaggaatcaggttttttctacctggtaaacattctctattcttttctcaaaagattgctgtaagaaaaaatgtaagacaaaaaaaaaaaaaaaaaacaaacagaggcagaggcaggcagtagcaagaaagcagagcgtaacatcagctagatggtaacatgcaatgtcagctctcttgaagacatgggaaacctaagttacaccttgggttaaaattcttcaccatattagttttgttgcttcataaaatttacctaagcaagtggtcttgcttgcctcaaatccaagcagtcttgaacacttggaggcaattaatgagtatatcttagtcaaaagaattgttggagctttttattaaagctacagtttcagttctgcttttggggaattgtgctatgaaagcagctgccaaaataagctcatttattttcttcaatcccactcagtgctcagtcactatattctgtttcctttttttttttcaagttgcatatttggtttccccttatgattgggaaagatgaattttcagcagaaaacattgtttgttcactttcaaagagtgatagtttctaaaacatttagagcaataaatattcatcagaggtaccaagtaagccggcagaagagttaagggttagagaaatcccttatttcatgtcttgactctaaaattatcaaagtacttttccttgtaatgtggatttcttcttatgcggatatgcaaaaacttcagttatacgtagtaatgctagcaggtaattttagtagacattttataacaactgtcactttgtttcgccacatgtagagtttgttcagctattttccagatatctccccacaaaaggaggcaaagggtaccagcttttcaatgagcattacctattacttggcaaagatgatgaagactctattaatagttcatttgataaatgttgacataaccaacaatagagattaggaagttagttttaagaaatcaatggcatatagacattaccctcatggagtttgtattctactacttgaactgattgtagctataaaagcatagttagatagctgaatagttagatcataagcaaagaaggccagaacacatctcttatcaagaaatcaatgaatagtttatctcatttttaaagcaactttatccttctttaattccttcctttcttctagtgcaaaactacttaataaggttggtgtttaggttagtgttcacaccattcctcatctggtgtgaattaccttctctttctttactatttactaccaacctagtacatgtgttgactgaattcttttcaaacaatgttgagttatcatggtgcacctaataaattaacaccacagattacagcatccttgctgattttctcagcaaagccagattagatggaaataaacaaagaaaatgatcctagagtgaatttttctagaaaatatctattatgaaccatgctgtttaaagtattagcttgaaggtgatggatccagctattcagaaaataactttcatataaccatgattttgcacagtatgaggtcttaaatgtgtggaaagagataaattttttatcattaccacaaaccccttttaaagattcaaaggtggaagaaagtgatttattttttctcttcagcatacatatataaaagacttgtcagatgtttaatttggggaggttgataatgaaacatatcaacagagtatagtagttatagtagtgtttgtgggtaaataatttcctggggtcagacatatataaacatatttgcttcaaaatgataaaggcatgaaatcagtcttaaaaattgaaatgggggtgatgggggagaaaaagaagaacaaatttgaagtgccctttcaaatctgctggatacaagtattgaagttttaagtcatcttattctgtctgaaagtgtatttttcattctacaatagacccaatcaacaagacgtataacttgagttgcatgatgttcagtttatgtaatctactgttgggatggtaagaattgatgtaggctgtggtgtaagaatgaattaaaatatagtttcactggcttttctctacatatccactatcacaatggctaggtttcctgttgctcactattggattctggagaaaaatttaatgaaagatgatatcagaggaagaataagtggaggtagagaagaaaggaatgatagaggaggggaaaaaaacaaaacatatttttgtgttatccaaaggagctttttccttattctgtcaagcattgagatcttcttcagctttcaatgtagttgctaaatacaaataatgctactaggtagtgactaaatatagcaaacacttcatcagatattagaattaggtcacactattgaggttataatctgaaggttgtgttacatagaaaccactttagattattatcaacttggactaggctttattttataatagcatagtaagtaatatctattgtgtcatttcttcaaccattttattctaagatccatgaagcttcttgaggccaaataaaataataagtttagacaagaagtagattgtgacttttttcccttagagatactatttactatctcctatcctgataggtggaaggtttactgaattggaaattggttgactattagtttttaactaaaatgtgcaataacacattgcagtttcctcaaactagtttcctatgatcattaaactcattctcagggttaagaaaggaatgtaaatttctgcctcaatttgtacttcatcaataagtttttgaagagtgcagatttttagtcaggtcttaaaaataaactcacaaatctggatgcatttctaaattctgcaaatgtttcctggggtgacttaacaaggaataatcccacaatatacctagctacctaatacatggagctggggctcaacccactgtttttaaggatttgcgcttacttgtggctgaggaaaaataagtagttcgaggaagtagtttttaaatgtgagcttatagatagaaacagaatatcaacttaattatgaaattgttagaacctgttctcttgtatctgaatctgattgcaattactattgtactgatagactccagccattgcaagtctcagatatcttagctgtgtagtgattcttgaaattctttttaagaaaaattgagtagaaagaaataaaccctttgtaaatgaggcttggcttttgtgaaagatcatccgcaggctatgttaaaaggattttagctcactaaaagtgtaataatggaaatgtggaaaatatcgtaggtaaaggaaactacctcatgctctgaaggttttgtagaagcacaattaaacatctaaaatggctttgttacaccagagccatctggtgtgaagaactctatatttgtatgttgagagggcatggaataattgtattttgctggcaatagacacattctttattatttgcagattcctcatcaaatctgtaattatgcacagtttctgttatcaataaaacaaaagaatcctgtttgtgtggtttcatgaaatcagcattgttgaatgcatgaagtaataatgctaaattaacatttttatgatgtctcaaggtttctggtcaagggaagtaaatgtaggatagtatttttacaccaaaatgacacagagagaattgagcacaccagaaagaccagaaaccacaccactggatagagattcaatatgtttctttttcaaacatttggacaagaaaaaaatgggcatttaaaaattcttccttcccctggttatggatttatctgtagtaaaacttagctttgtcgtttgagatttgcacagaatggggggagtagattacctcttcccattcattgtcataatggatctacatcactgataaacaccatacttctatatgtggttaactagctttagaataaaagacactttaaaaagtaaaaggcctagagatcttcaatgaagtgtcccttttagccaaaccaggccttgcagaaattgtcctcaaaagcaccaagggagaacaaagccaagtgcagaattacccaagggtcacacattttgtattcattttcttataatttgcccaaatgatttgaagtacagcaaaacctgaagttttgcaaagagttactgtaaactgaacttaaaaatgtcagagtgctcggtgacccacttctccagaccctgtcaacctgtgaaaatattggcctttattcagatctctcaagaagttacgcgcagagtttggaaggtctaggcaaaggttattagtcaagtgttcttacagtgtcaacgctcaattcccacaagcgtgagaaagagagacctgtcattcctgagggtgatgacatacatttactggagcttatataatttatcagataagacagcagtttccttcagggtagaaagtgtgttttctacattgatttagtacaaaacaaaaagaaaaggggatatttcaaattttataattatttttctgctaagctgattcagtgtgatttaagcatatttttcaaatcatgaatctgattccatatacatatgtgccttatattgtgataatttatttttaagtgaaatatgctatcatagcctgactttatgtatagtggtgacaacttgcaggatcgcatttctgtaaccaaacggccgacagctgaggtgtagatgcttcctatggtctgtagaataatcactgggcttgttctctagctatgtctgtatgcaatcgcgacagtgttgatcaaaacccatgatcattctctccaaaggtctttgtcactaagccactagggattctgaaaagttcgtgagctgaaacaaataaattgagttggaagatt

SEQ ID NO: 173 - DNA, 18335 bp, Homo sapiens
agtccgaggtcggccgcccgcggcagcgcagggcagcggggcagagcgcggctcccgcccgcccgccccgtgcgccggagccgggaccagcgactggacgcgacgggccgccaggcccgcaccgcctggccgccgcgatgtgcgactgcttccacatggtgctgcccacctggcccggaacccccggcagcgtgtccggccgtcagctgcagcccggggagccaggtgcagaaacggaagatgaccactctgtgactgaagggcctgcggatgagggcattcgaccacggccgcaggggtcttcacctgtctacgaatacacgactgaggctgccgactttggactccaggaagacgcccccggcaggcaaggttctgctgggagacggagatcctggtggaagcgagattcaggggactcacggacatttttcaggatgagtcgtccagaggctgtccaggaggcaacagaggtgacgctgaagacagaggtggaggcaggagccagtggctacagtgtcacaggtggtggggaccaggggatcttcgtcaagcaagtgctgaaggactcctcagccgccaagctttttaacttgagagaaggggatcagctgctcagtacaaccgtgttctttgaaaacataaaatatgaagatgctctcaaaatccttcaatattcagagccgtacaaggttcagttcaaaatcagacggcagctccctgccccacaggatgaagagtgggcttccagcgatgcccagcacggcccacagggcaaggagaaggaggacacggatgttgctgatgggtgcagagagacccccacgaaaactctggaaggagatggggaccaagagagactcatctccaaaccaagggtggggagaggcaggcagagccagagggagaggctctcttggccaaaatttcaatccataaagagcaagcgggggccgggaccccagaggtcacacagctcgtcagaggcctacgaacctagggacgcacatgacgtgtcccctacaagcacagacacagaggcccagctcacggtggagcgccaagagcagaaggcagggccgggcagccagaggaggcggaagttcctcaacctcagattcaggacaggctcgggacagggcccttcatcgacaggacagccaggcagggggttccagagtggggtgggccgtgctggggtcctggaagagttggggccctggggtgatagcctcgaggagactggggctgccacaggcagcaggagagaggagagggcagaacaggatcgagaagtgatgcctgctcagagcatgccattgcccacagagctcggtgaccctagactttgcgagggaacccctcaggaagggggactcagggcagccaggctccatggaaagaccctggaggggcaggcacaggagacagcagtggcccagaggaagcccagggcccagccaactcctggaatgagccgggagggtgaaggcgagggactgcagagcctggaaatcgggatcgccagactgtccttgagagacacaaccgaaggaggcacacagattggcccaccagaaattagggtgcgagtacacgatttaaagacaccaaaatttgcattttccacagaaaaagagccagaaagagaaaggcgccttagtaccccacagcgagggaagagacaggatgcgtcctcaaaagcgggtactggcctgaagggtgaggaggtggaaggagccgggtggatgccgggcagggaaccaaccacacatgcagaagcacagggggatgaaggagatggagaggaaggactacagaggacaaggatcactgaggaacaggacaagggcagggaagacacagaaggacagataagaatgcccaagttcaagataccctccttaggatggtcgccaagcaagcacacaaagacaggcagagaaaaagccacagaagacacagagcagggaagggaaggagaggccacagcaacagctgatagaagagaacagagacgcacagaggaaggattaaaagacaaagaagacagtgactcaatgacaaacacaacaaaaatacaactaatacacgatgaaaaacgcttaaaaaaggaacaaattctgacagaaaaggaagtggccaccaaagacagcaagttcaaaatgcccaagttcaagatgccattgttcggggcgtcagccccaggcaagtccatggaggcctcggtggatgtgtctgcgccgaaggtggaggccgacgtgagcctcctctccatgcagggggacctcaagaccactgacctcagcgtccagaccccttccgctgacctggaggtccaggatggccaagtggatgtgaaacttccggagggccccctgcccgagggagccagcctcaaagggcacctgcccaaggtgcagaggcccagtttgaagatgcccaaagtggacctcaagggccccaagctggacctgaaaggccccaaggcggaagtgacagcccccgatgtgaagatgtctctgtccagcatggaggtggacgtccaggccccgagagcaaagctggatggtgcgcggctggagggggacctgtccctggccgacaaggaggtgactgccaaagacagcaagttcaaaatgcccaagttcaagatgccatcattcggggtgtcggccccaggcaagtccatggaggactcggtggatgtgtctgcgccgaaggtggaggccgacgtgagcctctcctccatgcagggggacctcaaggccactgacctcagcattcagcccccttccgctgacctggaggtccaggctggccaagtggatgtgaaacttccggagggccctgtgcccgagggagccggccccaaagtgcacctgcccaaagtggagatgcccagtttcaagatgcccaaagtggacctcaagggcccccagatagatgttaagggccccaagctggacctgaaaggccccaaggcggaagtgacagcccccgatggcgaggtgtctctgcccagcatggaggtggatgtccaggcccagaaggccaagctggatggtgcgtggctggagggggacctgtccctggccgacaaggacgtgactgccaaagacagcaagttcaaaatgcccaagttcaagatgccgtcgttcggggtatcggccccagggaagtccatcaaggccttggtggatgtgtctgcacccaaggtggaggccgacctgagtctcccctccatgcagggggacctgaagaccactgacctcagcattcagcctgcttctactgacctgaaggtccaggctgaccaggtggatgtgaagctcccggagggccacctgcccgagggagctggccttaaagggcacttgcccaaggtggagatgcccagtttcaagatgcccaaagtggccctcaagggcccccaggtggacgtcaagggccccaagctggacctgaaaagccccaaggcggaagtcacagcccctgatgtggaggtgtctctgcccagcgtggaggtggacgtcgaggccccgggagccaagctggacagtgcgcggctggagggggaactgtccctggccgacaaggatgtgactgccaaagacagcaggttcaaaatgcccaagttcaagatgccatcgttcggggcgtcagccccaggcaagtccatcgaggcctcggtggatgtgtctgcacccaaagtggaggccgacgtgagtctcccctccatgcagggggacctcaagaccactgacctcagcattcagcccccttccgctgacctggaggtccacgctggccaggtggacgtgaagctcctggagggccacgtgcctgagggagccggcttcaaagggcacctgcccaaggtgcagatgcctagtttgaagatgcccaaagtggacctcaagggcccccaggtggaagtcaggggccccaagctggacctgaaaggtcataaggcagaggtgacggcccacgaagtggctgtgtctctgcccagtgtggaggtggacatgcaggccccgggagccaagttggatggcgcacagctggacggggacctgtccctggctgacaaggacgtgactgccaaagacagcaagttcaaaatgcccaagttcaagatgccgtcgttcggggtgtctgccccaggcaagtccattgaggcctccgtggacctgtctgcacccaaggtggaggccgacatgagcctcccctccatgcagggggacctcaagaccactgacctcagcattcagcccccttccactgacctggagctccaggctggccaattggacgtgaaactcccagagggccccgtgcccgagggagccggcctcaaagggcacctgcccaagctgcagatgcccagtttcaaggtgcccaaagtggacctcaagggccctgaaatagacatcaagggccccaagctggacctaaaagaccccaaggtggaagtgacagcccctgatgtggaggtttctctgcccagcgtggaggtggatgtcgaggccccaggagccaagctggatggtggacggctggaggaggacatgtccctggccgacaaggacttgactaccaaagacagcaagttcaaaatgcccaagttcaagatgccgtcgttcggggtgtctgccccaggcaagtccatcgaggcctcagtggatgtgtctgcgccgaaggtggaggccgacgtgagcctcccctccatgcagggggacctcaaggccactgacctgagcatacagcccccttctgctgacctggaggtccaggctggccaagtggacgtgaaactcccagagggccctgtgtccgagggagccggcctcaaagggcacctgcccaaagtgcagatgcccagtttcaagatgcccaaagtggacctcaaggggccccagatagatgttaagggccccaagctggacctgaaaggccccaaggtggaagtgacagcccccgatgtgaagatgtctctgtccagcatggaggtggacgtccaggccccgagagcaaagctggatggtgcgcagctggagggggacctgtccctggccgacaaggcggtgactgccaaagacagcaagttcaaaatgcccaagttcaagatgccatcatttggggtgtcggccccaggcaagtccatcgaggcctcggtggatgtgtctgagccgaaggtggaagctgatgtgagcctcccctccatgcagggggacctgaagaccactgacctcagcattcagtccccttccgccgacctggaggtccaggctggccaagtgaacgtgaaactcccggagggcccccttcccgagggagccggcttcaaagggcacctccccaaggtgcagatgcccagtttgaagatgcccaaagtggccctcaagggcccccagatggacgtcaagggccccaagctggacctgaaaggccccaaggcggaggtgatggcccccgacgtggaggtgtctctgcccagcgtggaggtggacgtcgaggctccaggagccaagctggacagtgtgcggctggagggtgacctgtccctggccgacaaggatgtgactgccaaagacagcaagttcaaaatgcccaagttcaagatgccgtcgttcggggtgtctgccccaggcaagtccatcgaggcctcggtggatgtgtctgcgccgaaggtggaggccgaagtgagcctcccctccatgcagggggacctcaagaccacggacctctgcattccgctcccttctgcagacctggtggtccaggctggccaagtggacatgaagctcccggagggccaggtgcccgagggagccggcctcaaagggcacttgcccaaggtggatatgcccagtttcaagatgcccaaagtggacctcaagggcccccagacagatgttaagggcgccaagctggacctgaaaggccccaaggcggaagtgacagcccccgatgtcgaggtgtctctgcccagcatggaggtggatgtccaggcccagaaggctaagctggatggtgcgcggctggagggagacctgtccctggccgacaaggacatgactgccaaagacagcaagttcaaaatgcccaaattcaagatgccgtcgttcggggtatcggccccagggaggtccatcgaggcctcggtggatgtgcctgcacccaaggtggaggccgacgtgagtctcccctccatgcagggggacctgaagaccactgacctcagcattcagcccccttctgccgacctgaaggtccagactggccaggtggatgtgaagctcccggagggccacgtgcccgagggagctggcctcaaagggcacctgcccaaggtggagatgcccagtttgaagatgcccaaagtggacctcaagggcccccaggtggacatcaagggccccaaactggacctaaaagaccccaaggtggaaatgagagtccccgatgtcgaggtgtctctgcccagcatggaggtggacgtccaggccccaagagccaagctggatagtgcgcatctgcagggggacctgaccctggccaacaaggacctgactaccaaagacagcaagttcaaaatgcccaagttcaagatgccgtcgtttggggtgtctgccccaggcaagtccatcgaggcctcggtggatgtgtctccacccaaggtggaggccgacatgagtctcccctccatgcagggggacctcaagaccactgacctcagcattcagcccctttccgccgacgtgaaggtccaggctggccaggtggacgtgaaactcctggagggccctgtgcccgaggaagtcggcctcaaagggcacctgcccaagctgcagatgcccagtttcaaggtgcccaaagtggacctcaagggccccgaaatagacatcaagggccccaagctggacctaaaagaccccaaggtggaagtgacagcccctgatgtggaggtgtctctgcccagcgtggaggtggacgtcaaggccccaggagccaagctggatggtgcgcggctggagggggacatgtccctggccgacaaggacgtgactgccaaagacagcaagttcaaaatgcccaagttcaagatgctgtcgtttggggtgtctgcccttggcaagtccatcgaggcctcagcggatgtgtctgcgttgaaggtggaggccgacgtgagcctcccctccatgcagggggacctcaagaccactgacctcagcgttcagcccccttccgctgacctggaggtccaggctggccaagtggatgtgaaactcccagagggccccgtgccggagggagccggcctcaaagggcacctgcccaagctgcagatgcccagtttcaagatgcccaaagtagatctcaagggcccccagatagatgtcaagggccccaagctggacctgaaaggccccaagacggacgtgatggcccccgacgtggaggtgtctcagcccagcgtggaggtggatgtcgaggccccgggagccaagctggatggtgcgtggctggagggggacctgtctgtggcggacaaggatgtgactaccaaagacagcaggttcaaaattcccaagttcaagatgccgtcattcggggtgtctgccccaggcaagtccatcgaggcctcggtggatgtgtctgcgccgaaggtggaggccgacgggagcctctcctccatgcagggggacctcaaggccactgacctcagcattcagcccccttccgctgacctggaggtccaggctggccaagtggacgtgaaactcccagagggccctgtgccggagggagccggcctcaaagggcacctgcccaaggtgcagatgcccagtttcaagatgcctgaaatggacctcaagggcccccagctagatgtcaagggccccaagctggacctgaaaggccccaaggcggaagtgacagcccccgatgtggagatgtctctgtccagcatggaggtggacgtccaggccccgagagcaaagctggatggtgcgcggctggagggggacctgtccctggccgacaagggtgtgacagccaaagatagcaagttcaaaatgcccaagttcaagatgccatcattcagggtgtcggccccaggcgagtccatcgaggcgttggtggatgtgtctgagctgaaggtggaagccgacatgagcctcccctccatgcaaggggaccttaagaccactgacatcagcattcagcccccctctgcccaactggaggtccaggctggccaggtggatgtgaaactcccagagggccacgttcccgagggagccggcctcaaagggcacctgcccaagctgcagatgcccagtttcaagatgcctgaagtggacctcaagggcccccagatagatgttaagggccccaacgtggacctgaaaggccccaaggcggaagtgacagcccccgatgtgaagatgtctctgtccagcatggaggtggacgtccaggccccgagagcaaagctggatggtgcgcggctggagggggacctgtccctggccgacaagggcatgacagccaaagacagcaagttcaaaatgcccaagttcaagatgccgtcattcggggtgtcggccccaggcaagtccatcgaggcctcggtggatgtgtctgagctgaaggtggaagctgacgggagcttcccctccatgcaaggggatcttaagaccactgacatccgcattcagcccccctccgcccaactggaggtccaggctggccaggtggacgtgaaactcccagagggccacgttcccgagggagccggcctcaaagggcacctgcccaaggtgcagatgcccagtttcaagatgcccaaagtggatctcaagggcccccagatagacgtcaagggccccaagctggacctgaaaggccccaaggcggaggtgacggcccccgacgtggaggtgtctctgcccagcgtggaggtggacgtcgaggccccgagagcaaagctggatggtgcacggctggagggtgacctgtccctggccgacaaggatgtgactgccaaagacagcaagttcaaaatgcccaagttcaagatgccgtcgttcggggtgtctgccccaggcaagtccattgaggtctcggtggatgtgtctgcgccgaaggtggaggccgaagtgagcctcccctccatgcagggggacctgaagaccactgacatcagcattgagcccccctctgcccaactggaggtccaggctggccaggtggacctgaagctcccagagggccacgttcccgagggagctggcctcaaagggcacctgcccaagttgcagatgcccagtttcaagatgcccaaagtagatcgcaagggaccccagatagatgtcaagggccccaagctggacctgaaaggcccgaagacggacgtgacggcccccgacgtggaggtgtctcagcccggcatggaggtggatgtcgaggccccaggagccaagttggatggtgcacggctggagggggacctgtccctggccgacaaggatgtgactgccaaagacagcaagttcaaaatgcccaagttcaagatgccgtcgttcggggtgtctgccccaggcaagtccattgaggtcttggtggatgtgtctgcgccaaaggtggaggccgacctgagcctcccctccatgcagggggacctgaagaacactgacatcagcattgagcccccctctgcccaactggaggtccaggctggccaggtggacgtgaagctcccagagggccacgttctcgagggagctggcctcaaagggcacctgcccaagttgcagatgcccagtttcaagatgcccaaagtagatcgcaagggcccccagatagacatcaagggccccaagctggacctgaaaggcccgaagatggatgtgacggcccccgacgtggaggtgtctcagcccagcatggaggtggacgtcgaggccccaggagccaagttggatggtgcacggctggagggggacctgtccctggccgacaaggatgtgactgccaaagacagcaagttcaaaatgcccaaattcaagatgccgtcgtacagggcgtctgccccaggcaagtccatccaggcctcggtggatgtgtctgcgccgaaggcggaggccgacgtgagcctcccctccatgcagggggacctcaagaccactgacctcagcattcagctcccttctgtggacctggaggtccaggctggccaggtggacgtgaagctcccggagggccacgtgcccgagggagctggcctcaaagggcacctgcccaaggtggagatgcccagtttcaagatgcccaaagtggacctcaagagcccccaggtggacatcaagggccccaagctggacctaaaagtccccaaggcggaagtgacagtccctgatgtggaggtgtctctgcccagcgtggaggtggacgtccaggccccgagagccaagctggatggtgcgcggctggagggggacctgtccctggctgaaaaggatgtgactgccaaagacagcaagttcaaaatgcccaagttcaagatgccctccttcggggtgtcggccccaggcaggtccatcgaggcctcgctggatgtgtctgcgccgaaggtggaggccgacgtgagcctctcctccatgcagggggacctcaaggccactgacctcagcattcagcccccttccgctgacctggaggtccaggctgtccaagtggatgtggaactcctggagggccccgtgcccgagggagccggcctcaaagggcacctgcccaaagtggagatgcccagtttaaagacgcccaaagtggacctcaagggcccccagatagatgttaagggccccaagctggacctgaaaggccccaaggcagaagtgagagtccccgatgtcgaggtgtctctgcccagcgtggaggtggatgtccaggccccgaaggccaagctggatgctgggcggctggagggagacctgtccctggctgacaaggacgtgactgccaaagacagcaagttcaaaatgcccaaattcaagatgccgtcattcagggtatcggccccagggaagtccatggaggcctcggtggatgtgtctgcacccaaggtggaagccgatgtgagtctcccctccatgcagggggacctgaagaccactgacctcagcattcagcccccttctgccgacctgaaggtccaggctggccagatggatgtgaagctcccggagggccaggtgcccgagggagccggcctcaaagagcacctgcccaaggtggagatgcccagtttgaagatgcccaaagtggacctcaagggcccccaggtggacatcaagggccccaagctggacctaaaagtctccaaggcggaagtcacagcccctgatgtggaggtgtctctgcccagcgtggaggtggacgtccaggccccaagagccaaactggatagtgcacagctggagggggacctgtccctggccgacaaggatgtgactgccaaagacagcaaattcaaaatgcccaagttcaagatgccgtcatttggggtgtctgccccaggcaagtccattgaggcctcggtgcacgtgtctgcacccaaggtggaggccgatgtgagtctcccctccatgcagggggacctcaagaccactgacctcagcattcagccccattctgccgacctgacggtccaagctcgccaggtggacatgaaactcctggagggccacgtgcccgaggaagccggcctcaaaggacacctgcccaaggtgcagatgcccagtttcaagatgcccaaagtcgacctcaagggccctgaaatagacatcaagggccccaagctggacctaaaagaccccaaggtggaagtgacagcccctgatgtggaggtttctctgcccagcgtggaggtggacgtcgaggccccaggagccaagctggatggtgcgcggctggagggggacctgtccctggccgacaaggacatgacggccaaagacagcaagttcaaaatgcccaagttcaagatgccgtcgttcggggtgtctgccccaggcaagtccatggaggcatcagtggatgtgaccgcgccaaaggtggaggccgacgtgagcctcccttccatgcagggggacctcaaggccactgacctcagcgttcagcccccttccgctgacctggaggtccaggctggccaagtggacgtgaaactcccagagggccccgtgcccgagggagccagcctcaaagggcacctgcccaaggtgcagatgcccagtttcaagatgcccaaagtggacctcaagggcccccagatagatgttaagggccccaagctggacctgaaaggccccaaggcggaagtgacagcccctgatgtgaagatgtctctgtccagcatggaggtggacgtccaggccccgagagcaaagctggatggtgtgcagctggagggggacctgtccctggccgacaaggatgtgactgccaaagacagcaagttcaaaatgcccaagttcaagatgccatcattcggggtgtcggccccaggcaagtccatggaggcgtccgtggatgtgtctgagctgaaggcgaaagccgacgtgagcctcccctccatgcagggggacctcaagaccactgacctcagcattcagtccccttccgccgacctggaggtccaggctggccaagtggacgtgaaactcccggagggccccctgcccaagggagccggcctcaaagggcacctccccaaggtgcagatgccctgtttgaagatgcccaaagtggccctcaagggcccccaggtggatgtcaagggccccaagctggacctgaaaggccccaaggcggatgtgatgacccccgtcgtggaggtgtctctgcccagcatggaggtggacgtcgaggccccgggagccaagctggacagtgtgcggctggagggtgacctgtccctagccgacaaggacatgactgccaaagacagcaagttcaaaatgcccaagttcaagatgccgtcgttcggggtgtctgccccaggcaagtccatcgaggcctcgttggatgtgtctgcgctgaaggtggaggctgacgtgagcctcccctccatgcagggggacctgaagaccactcacctcagcattcagcccccttccgctgatctggaggtccaggctggccaagaggatgtgaaactcccagagggccctgtgcatgagggagccggcctcaaagggcacctgccgaagctgcagatgcccagtttcaaggtacccaaagtggacctcaagggtccccagatagacgttaatgtccccaagctggacctgaaaggccccaaggtggaggtgacgtcccccaacctggacgtgtctctgcccagcatggaggtggacatccaagccccaggagccaagctggacagtacgcggctggagggggacctgtccctggctgacaaggacgtgactgccaaagacagcaagttcaaaatgcccaagttcaagatgccatcctttgggatgttgtccccaggcaagtccatcgaggtctcggtggatgtgtctgcgccaaagatggaggccgacatgagcattccctccatgcagggggacctcaagaccactgacctccgcattcaggccccttccgccgacctggaggtccaggctggccaggtggacttgaaacttccagaaggccacatgcccgaggtagccggcctcaaagggcacctgcccaaggtggagatgcccagtttcaagatgcccaaagtggacctcaagggcccccaggtggacgtcaagggccccaagctggacctgaaaggcccaaaggcagaggtgatggcccccgatgtggaggtgtctctgcccagcgtggagacggatgtccaggccccaggatccatgctggatggtgcgcggcttgagggggacctgtccctggcccacgaggatgtagctgggaaagacagtaagtttcaaggaccaaaactgagcacgtctggttttgaatggtcgtcaaagaaagtttccatgtcttcctctgaaatcgaaggaaatgttacattccatgagaagacttccacatttcccattgtggaatctgttgttcatgaaggtgatcttcatgatccatctcgcgatggtaacttggggcttgctgttggagaagttggaatggattcgaagtttaagaaactgcattttaaagtgcccaaagtttcattttcttctaccaaaactcctaaagatagtttagtcccaggtgcaaagtctagcataggtctttccacgattcctttatcatcttcagaatgctcaagttttgaattacaacaggtttcggcttgttcagagccatccatgcagatgcctaaggtgggttttgctgggtttccatcatcccggcttgatctcactggtcctcactttgaatcttctattctctctccctgtgaggatgttacacttacaaaataccaggtgactgttcccagagctgccttggcccctgagcttgctctggaaattccttctgggtctcaggctgatattcctcttcccaagacagagtgctccactgacctgcagcctccagagggagttccaacatctcaagctgagagtcactctggcccactgaattccatgattcctgtttctcttggtcaggtatcttttcctaaattctataaaccaaagtttgtgttttcagtcccccaaatggcagttcctgagggagacctacatgcagcagtgggtgccccagtcatgtctcctcttagccctggagaaagagtgcagtgccccttgccaagcacccagctgccatccccaggcacctgtgtgtctcagggcccagaagagcttgtggcctccttgcagacatcagtagtggcccctggagaagccccttctgaagatgctgaccacgaagggaaagggagtcccttgaaaatgcctaagattaagcttccatcatttaggtggtccccgaagaaggaaacagggccaaaggtggacccagaatgcagcgtggaggactcaaaactcagcctggttttagacaaggatgaagtggccccgcagtctgccatccacatggatctgcctcctgagagggatggagagaaggggaggagcacaaagcctggctttgccatgccaaaacttgcacttcccaaaatgaaggcttctaagagtggggtcagcctgccacagagagacgtggatccttccctttctagtgccacagcagggggtagctttcaagacacagaaaaggccagcagtgacggtggtaggggaggacttggtgcaacagcaagtgccacaggaagtgagggtgtgaacctccaccggccacaggtccacattcccagtttgggctttgccaaacctgatctcagatcctccaaggccaaggtggaggtgagccagcctgaagctgacctgcctcttcccaaacatgatctgtctaccgaaggtgacagcagaggatgtgggctcggggatgtcccagtgagccagccttgtggggaggggatagcccccacacctgaagatcccctccagccatcctgtagaaaaccagatgctgaagtcctcacagtggaaagcccagaggaggaagccatgaccaagtactcgcaggaaagctggtttaaaatgcccaagttccgcatgcccagccttaggcgctctttcagggacagaggcggggctggaaagctggaagtggctcagacacaggcaccggcagcaacagggggtgaagcagcagctaaagtcaaagagttccttgtttctgggtcaaacgtggaggcagctatgtccctacagctcccagaggcagatgcagaagtgacagcttctgagagcaaatcatccacagatattctaaggtgtgatcttgacagcacaggcttgaagctgcacctctccactgctgggatgactggggatgagctttccacttctgaggtcaggatccatccatccaaaggacctctcccttttcagatgcctggcatgaggcttccagaaacccaggttcttccaggagaaatagatgagactcctctttccaagccaggacatgaccttgccagcatggaggataaaacagagaaatggtcttcccagcctgaaggtccacttaaattgaaagcttcaagtactgatatgccatcccagatttctgtggttaatgtggatcaactgtgggaagattctgtcctaactgtcaaattccccaaattaatggtaccaaggttctccttccctgcccccagctcagaggatgatgtgttcatccccactgtgagggaagtgcagtgtccagaggccaatattgatacagccctttgtaaggaaagtccggggctctggggagccagcatcctgaaggcaggtgctggggtccctggggagcagcctgtggaccttaacctgcctttggaagctcccccaatttcaaaggtcagagtgcatattcagggtgctcaggttgaaagtcaagaggtcactatacacagcatagtgacaccagagtttgtagatctctcagtacccaggactttttccactcagattgtgcgggaatcagagatccccacgtcagagattcaaacaccttcgtacggattttccttattaaaagtgaaaatcccagagccccacacgcaggctagagtgtacacaacaatgactcaacactctaggactcaggagggcacagaagaggctcccatacaagccaccccaggagtagactccatttctggagatctccagcctgacactggagaaccatttgagatgatctcttccagcgtcaatgtactgggacagcaaacactcacatttgaagttccttctggccaccagcttgcagacagctgttcagatgaggagccagcagaaattcttgagtttccccctgatgatagccaagaggcaaccacaccactggcagatgaaggcagggctccaaaagacaaaccagaaagtaaaaaatctggtctgctctggttttggcttccaaacattgggttttcctcttctgttgatgagacaggtgttgattccaaaaatgacgtccagagatctgctcccattcaaacacagcctgaggcacgaccagaggcagaactgcctaaaaaacaggagaaggcaggctggttccgatttcccaaattagggttctcctcatctcctaccaagaaaagcaaaagcaccgaagatggggcagagctggaagaacaaaaacttcaagaagaaacaatcacgttttttgatgcccgagaaagtttctcccctgaagagaaggaagagggtgaactgatcgggcctgtgggcactgggctggactccagagtgatggtgacatccgcggcaagaacagagttaatcctgcccgagcaggacagaaaagctgacgatgaaagcaaagggtcaggcctgggaccaaatgaaggctgagaggtatggctcatcagtacaagagagatgcaaaaaactaagttggaaagtaaaggctacacacacatatggagcaccccatcccacagcacattacatccacctcacttcacagaacggagaacagagcagaaatgaccagaacacctttgtcaccatcacacagccctcctaaaatggaaccaaagcttcccagctccctcaaagctttggatgcaaagaaggcaccctgacttccacaagacaccagaattcacacggtactcagaggcactgctggggaagtttgttggtctttattagataaatttccagagacctgtccataatacccaacagaacatgactgtttctttgaggaaagggttataatgtctgtggtgtacaagtcgtttttggtataacttctttcctgctgctgctgcttcccggcaaacatagttttcctatttcaggcagagtgcggtatattccaggaaacactgtttcctactcacttagcttacttctttgttgaatgcctcactaatggcaagtttcaagatgttttgggtgacaatgcacacatgctgggcaaaagggtgatggccagtggctggcagctgggccagcagaagctaggacatctgtgagttgtcattctcatctatccatgtccactggcctgccagcatccgccagtgccttgccagtgtgcacggtcccacactgtggcccctgagtcccctaatgtacacgctgcagccagaatgcagatggagctggcttggctgttccctggatgggcaataaagaaagtgctgcatccca

SEQ ID NO: 174 - DNA, 7813 bp, Homo sapiens
ccttttcctctcctcccccaggccggcggggaggcagcttccaccgccctccgcgcgccctcacccggccttgctctgcctccggggaccgccagcagcccgcctccaaaagtttgatcatctctctctctctttttcttgcttcttcttcctttttggtggaagcagaaaaggaccgaggcaggggcgagcgcggcgcccggactcctgggaccatgggcctggcgcgggcgcccgcggggccccagccgcgctgcctgcctgctcgggcgcccctgggcgcggggctgcgctgggggcgcgggggccgcgcgctctaagccggcctggcgcggcggggcggggggctggcggccccatggggcgcgcccacacttgccccccgggctcgggagcatgaagtaggggcctgccatgggagcgggatcggcgcggggggcccgaggcacagcggcggcggcggcggcgcgcgggggggggtttctcttctcctggatcttagtctcgtttgcctgtcacctggcctccacccaaggagctcctgaagatgtggacatcctccagcggctgggcctcagctggacgaaggccgggagccctgcacccccgggagtcattcctttccagtcgggcttcatctttacgcagcgggcccggctccaggctcccacgggcaccgtcattcctgccgccttgggcacagagctggcactggtgctgagcctctgctcccaccgggtgaaccatgccttcctcttcgctgtccgcagccagaaacgcaagctgcagctgggcctgcagttcctccccggcaagacggtcgtccacctcgggtcccggcgctcagtggccttcgacctcgacatgcacgacgggcgctggcaccacctggccctcgagctccgaggccgcacagtcactctggtgactgcctgcgggcagcgccgggtgcctgtcctgctgcctttccacagggaccctgcactcgaccctgggggctccttcctctttgggaagatgaacccgcatgcagtccagtttgaaggtgctctctgccagttcagtatctaccctgtgacgcaggtcgctcacaattactgtacccacctgaggaagcagtgtggacaggctgacacgtaccagtccccactgggacctctcttctcccaagactctggcagaccttttaccttccagtccgacctcgccctgctaggcctggagaacttgaccactgccacaccagccctggggtcactgccagcaggcaggggacccagggggactgtggcacccgccacgcccaccaagccccaaaggactagccccacaaaccctcaccagcatatggcggtgggaggcccagcccaaaccccgctgctacctgccaagctgtcagccagtaacgcacttgatcccatgctcccagcctctgttggcggctctaccagaacgcctcgccctgcggccgctcaaccatcacagaagatcacagccaccaaaatccccaaaagcctccctaccaagccttcggccccttctacttcaattgtgcccatcaaaagcccccatcctacccagaaaacagctccatcttcatttacaaagtcagccctacccactcagaagcaagtgccacctacttcccgtccagttcctgccagagtctcccgtcccgcagagaagcccatccagaggaacccgggaatgcccaggcccccaccgcccagcacccggcccctacctcctaccaccagctcctctaaaaaacccattcccacactagctcggactgaggccaagataaccagccatgccagtaagccggcctctgcccgcaccagcacccacaaacctcccccatttactgctttatcctcatctcctgcccctactcctggttctaccaggagtactcggccaccagccacgatggtacctccaacttcgggcaccagcactcccagaacagcacctgccgtccccactcctggctcagctcccactggaagcaagaagcccattggatcggaagcctcaaagaaagccggacccaagagcagcccccggaagcctgtccccctcagacctgggaaggcagccagggatgtccccttgagcgatctgacaaccaggcctagccccagacagccccagcccagtcagcagaccaccccggccctggtattggccccggcgcaattcctgtcctccagcccccggcccacgagcagtggctattcgatcttccacctggcaggatctacgcctttccctctgctgatggggcctccgggacccaagggagactgtggcttgccgggtccccctgggctacctgggctacctggaatccctggtgcacgtgggcctcggggtcctcctgggccttatggaaatccaggtctccccggccctcctggagccaaaggacagaaaggggacccagggctctcaccaggaaaggcccacgatggggcaaagggtgacatgggcttgcctgggctctccgggaatccaggacctccgggacgaaagggacacaagggctatcctggaccggcagggcaccccggagaacaggggcagccaggacctgagggcagcccaggggccaaaggttaccctggcaggcaggggttacctggaccggtaggagatcccggccccaaaggcagcaggggctacattgggctcccagggctcttcggcctgccagggtctgatggagaacgaggcctgcctggcgttcctggcaagaggggcaagatgggtatgccggggtttcctggagtctttggggaaagaggccctcctggactggatggaaatcctggagaactgggcctgccaggcccccctggagtccccggcctcattggtgacttaggagtgttgggtccgattggctacccgggacccaagggcatgaagggactgatgggcagcgtgggggagcccggactgaaaggtgataagggtgaacaaggggttccaggtgtgtcaggagatcccggattccaaggagacaaggggagccaggggttgccagggttccccggtgcacgggggaagccagggcctctgggcaaagtcggagacaaaggatccattgggtttcccgggccccctggacccgagggattcccaggagacatcggcccccctggcgacaatggcccagaaggcatgaagggtaagcctggagcccgaggcctgccgggaccccgtgggcagctggggcccgagggagatgagggacccatggggccgccaggggcccctggcttggagggtcagcctggcaggaaggggtttcctgggaggcccggcctggatggcgtgaagggggaaccaggggatcctggtcggccggggcctgtgggagagcagggatttatgggattcattggtctggtcggggagccaggaatcgtgggagaaaagggtgatcgtggcatgatgggacccccaggcgtgcctggacccaaggggtcgatgggtcatcctggaatgccaggtggtatggggacccctggagagcctggaccccagggtcctccaggatctcgaggcccaccaggcatgaggggagcaaagggacgtcggggcccccgaggaccggacggaccagctggggagcaagggtccaggggcctgaagggccctccaggaccccagggcagaccgggccggcctggacagcagggtgtggctggtgagcgaggccacttgggctcgagaggctttcctggcatcccgggtccctcaggccccccaggcaccaagggcctcccaggagaaccgggccctcagggaccccaggggccaattgggcctccaggagagatgggacccaaggggccgcctggtgcagtgggagaaccgggccttcctggggaagccgggatgaagggtgaccttggacccctgggcactcctggggagcagggcctcattgggcaacggggagagccaggccttgagggtgacagtggccccatgggacctgatgggctgaagggggacaggggagacccagggcctgatggagaacatggcgagaaaggccaggaagggctgatgggtgaggacgggccccccggcccccctggcgtcactggtgtccggggtcctgaaggaaaatcagggaagcaaggcgagaagggccgcactggagccaagggtgccaagggctatcaaggacagctgggtgagatgggcgtccctggagaccctggaccccctggcactccaggccctaaagggtcccggggcagcctgggaccaacgggtgctccgggacgcatgggggcccaaggagaaccgggactggctggttatgatggacacaaaggcattgtgggaccccttggacctcctggaccaaaaggcgaaaagggggagcagggcgaggacggcaaggctgaggggccccctgggccacctggagatcggggccctgtgggtgatcgaggagaccgcggggaaccgggagaccctgggtaccctggacaggagggtgtgcaaggcctccgtggaaagccaggccagcagggccaacccgggcatccgggaccccgggggtggccgggacccaaaggatcgaaaggcgcagagggaccaaagggaaagcaaggcaaggcaggggccccaggccggaggggggtccagggcctgcaggggctgccagggccccggggcgtggtggggagacagggcctcgagggcatcgctggaccagatgggcttcctggcagggacgggcaagcaggacagcagggggagcagggagacgatggggaccctggccccatgggccctgctgggaagagaggaaatccaggtgtggccggcttacctggagcacagggacccccaggattcaagggtgagagtgggttacccggacagctgggtccccctggcaagcgaggaacagagggcagaacggggctccctggaaaccagggggagcctgggtccaaaggccagccgggcgactctggcgagatgggcttcccaggaatggcaggtctcttcggacccaagggcccgcctggagacattggcttcaaaggcatccagggccctcgggggccacctggcttgatgggaaaggaaggcatcgtcgggcccctcggaatcctgggaccttcgggactcccgggtccgaagggtgacaaaggcagccgtggggactggggattgcaaggtccgaggggtcctcccggccccagagggcggcccggccccccgggtcctccagggggtcctatccaattgcaacaagatgatcttggggcagctttccagacgtggatggacaccagtggagcactcaggccagagagttacagctatccagaccggctggtgctggaccagggaggagagatctttaaaaccttacactacctcagcaacctcatccagagcattaagacgcccctgggcaccaaagagaaccccgcccgggtctgcagggacctcatggactgtgagcagaagatggtggatggtacctactgggtggatccaaaccttggctgctcctctgacaccatcgaggtctcctgcaacttcactcatggtggacagacgtgtctcaagcccatcacggcctccaaggtcgagtttgccatcagccgggtccagatgaatttcctgcacctgctaagctccgaggtgacccagcacatcaccatccactgccttaacatgaccgtgtggcaggagggcactgggcagaccccagccaagcaggccgtacgcttccgggcctggaatggacagatttttgaagctgggggtcagttccggcccgaggtgtccatggatggctgcaaggtccaagatggccgctggcatcagacactcttcaccttccggacccaagacccccaacagctgcccatcatcagtgtggacaacctccctcctgcctcatcagggaagcagtaccgcctggaagttggacctgcgtgcttcctctgacctctgacctcgtggccactctaggcctcacggaggagggaagaggaagaggcaaggggagggtactgaggggcagatggctccaggagaggcagctcccctgcccaagggtccttgggcagaccccagctgttgtctgcccagtagaagtgggtgggggtaggaggggatagggtgtccttgggaacaatggatcccagcttagccccaaagaccaaccaaagagccagccagagtaagctggacctgcaacctgcctgagccccgtggcctctcagctctgcggccaccccgttccctccccagcttcctgcccaaagagccccacattcaagccaacttgagggaagggggcgtctcgtcagctggtccctgctagggagctattgatgtgcaatattagaaaggagacatgaaaaaaggagaaaaggaaagacagaagtgtatatatatattatttaaacaaacaaaaagaaggtgcgttactatttttttttcacccgggaaagaggtgagaggatgggaaggagcagccaggcgtgggaagcggcgagatcctcgggctgggggtgcccacgtttgctacctcccactgtgaaatcgctggtgctcacaattgtctctcacagtgtatgtgatttttttaaggaaaaaaaaaaatccctatttaagattctgaaggtgctaccattattttgccacagactttgaagaaacttttggatgtggggcatcatccgcatctttctctctcctccaaatgacaaagtttggggaatttttgaattttcctagcatcgcccttgtgctcatcaggtaatctgctaaggaggaaaaaagaaaagaaaaaaggaaaaaaaaaaaaaaaaagcaaaacaaaaacaaaaacaaaaaccctaccagaaaccagaagtagagagatttaccatataacttatggactttgaaatgtctgtccttttaaggcagcagggaggcctgggtgcgaagcatgttggcttggcccttcacggtcctggagggaggtgaggctggccttggaaggcgtgccctggagaggtcttgggtgaaaacttgaccttgaagaaaccaatcacaaaagcggcgttgggtcagggctaggcttagaggtgaagcatcaacatggaaccatctcaggaagccgcatcgcctcttccgaggtcctcacttccaggagcctgtccttgcaagatgcaatcatcgttcctgctttttcattgtcattaaattctgtagaaacccattgtcattagctccaagtgtaaatttgggtcaaggagacagaataataatgggaatctcggagttcgacaccatagtgacgttcagcgtcctctgaattgtgctacatcagcgaacaagtcggcgcttgaattggattttgaggttattttaaccatggaattatttttatagaaggggaaaatgtatgtgaaagtctctatttgtgtatttctctcctaaagttgtgtctctttgggaattggatttgatttttattatttaatacctcactttggcccgtcccccctcccaacacttctgtatcctcgccctgccgccccagcctggacgctctgcgtggaagtgcgtgtttgtagcagctcgggcctcatctcagcgctcggatccctcctgctgccagaatccactggcctctgtctcattcttgggttttcctgctgtcttcgtttacgtctctgtccacatgtcagtgtattaaaaccccaatgggttccgtttctccttttcccctctggattttaaataaatatttaaaactgaggcaatggaa

SEQ ID NO: 175 - DNA, 8466 bp, Homo sapiens
ggagttaaacacaatctgcaggaaagcaaatggggactcggactcgctcctgggcgagctgaaagtcggctgcagcagaagctcctgccttgggagtttgccgcgagcgcgtctccttcattcgcaggctgggcgcgttcgcagtcggctggcggcgaaggaaggcgctctcgggacctcgcgggcgcgcgtcttttggctcttgcccctgtccctgcggcttggggaaggcgtaacccggcggctaggcgcgggagaagtgcggaggagccatgggcgccgggagctccaccgagcagcgcagcccggagcagccgcccgaggggagctccacgccggctgagcccgagcccagcggcggcggcccctcggccgaggcggcgccagacaccaccgcggaccccgccatcgctgcctcggaccccgccaccaagctcctacagaagaatggtcagctgtccaccatcaatggcgtagctgagcaagatgagctcagcctccaggagggtgacctaaatggccagaaaggagccctgaacggtcaaggagccctaaacagccaggaggaagaagaagtcattgtcacagaggttggacagagagactctgaagatgtgagcaaaagagactccgataaagagatggctactaagtcagcggttgttcacgacatcacagatgatgggcaggaggagacacccgaaataatcgaacagattccttcttcagaaagcaatttagaagagctaacacaacccactgagtcccaggctaatgatattggatttaagaaggtgtttaagtttgttggctttaaattcactgtgaaaaaggataagacagagaagcctgacactgtccagctactcactgtgaagaaagatgaaggggagggagcagcaggggctggcgaccacaaggaccccagccttggggctggagaagcagcatccaaagaaagcgaacccaaacaatctacagagaaacccgaagagaccctgaagcgtgagcaaagccacgcagaaatttctcccccagccgaatctggccaagcagtggaggaatgcaaagaggaaggagaagagaaacaagaaaaagaacctagcaagtctgcagaatctccgactagtcccgtgaccagtgaaacaggatcaaccttcaaaaaattcttcactcaaggttgggccggctggcgcaaaaagaccagtttcaggaagccgaaggaggatgaagtggaagcttcagagaagaaaaaggaacaagagccagaaaaagtagacacagaagaagacggaaaggcagaggttgcctccgagaaactgaccgcctccgagcaagcccacccacaggagccggcagaaagtgcccacgagccccggttatcagctgaatatgagaaagttgagctgccctcagaggagcaagtcagtggctcgcagggaccttctgaagagaaacctgctccgttggcgacagaagtgtttgatgagaaaatagaagtccaccaagaagaggttgtggccgaagtccacgtcagcaccgtggaggagagaaccgaagagcagaaaacggaggtggaagaaacagcagggtctgtgccagctgaagaattggttgaaatggatgcagaacctcaggaagctgaacctgccaaggagctggtgaagctcaaagaaacgtgtgtttccggagaggaccctacacagggagctgacctcagtcctgatgagaaggtgctgtccaaaccccccgaaggcgttgtgagtgaggtggaaatgctgtcatcacaggagagaatgaaggtgcagggaagtccactaaagaagctttttaccagcactggcttaaaaaagctttctggaaagaaacagaaagggaaaagaggaggaggagacgaggaatcaggggagcacactcaggttccagccgattctccggacagccaggaggagcaaaagggcgagagctctgcctcatcccctgaggagcccgaggagatcacgtgtctggaaaagggcttagccgaggtgcagcaggatggggaagctgaagaaggagctacttccgatggagagaaaaaaagagaaggtgtcactccctgggcatcattcaaaaagatggtgacgcccaagaagcgtgttagacggccttcggaaagtgataaagaagatgagctggacaaggtcaagagcgctaccttgtcttccaccgagagcacagcctctgaaatgcaagaagaaatgaaagggagcgtggaagagccaaagccggaagaaccaaagcgcaaggtggatacctcagtatcttgggaagctttaatttgtgtgggatcatccaagaaaagagcaaggagagggtcctcttctgatgaggaagggggaccaaaagcaatgggaggagaccaccagaaagctgatgaggccggaaaagacaaagagacggggacagacgggatccttgctggttcccaagaacatgatccagggcagggaagttcctccccggagcaagctggaagccctaccgaaggggagggcgtttccacctgggagtcatttaaaaggttagtcacgccaagaaaaaaatcaaagtccaagctggaagagaaaagcgaagactccatagctgggtctggtgtagaacattccactccagacactgaacccggtaaagaagaatcctgggtctcaatcaagaagtttattcctggacgaaggaagaaaaggccagatgggaaacaagaacaagcccctgttgaagacgcagggccaacaggggccaacgaagatgactctgatgtcccggccgtggtccctctgtctgagtatgatgctgtagaaagggagaaaatggaggcacagcaagcccaaaaaagcgcagagcagcccgagcagaaggcagccactgaggtgtccaaggagctcagcgagagtcaggttcatatgatggcagcagctgtcgctgacgggacgagggcagctaccattattgaagaaaggtctccttcttggatatctgcttcagtgacagaacctcttgaacaagtagaagctgaagccgcactgttaactgaggaggtattggaaagagaagtaattgcagaagaagaaccccccacggttactgaacctctgccagagaacagagaggcccggggcgacacggtcgttagtgaggcggaattgacccccgaagctgtgacagctgcagaaactgcagggccattgggtgccgaagaaggaaccgaagcatctgctgctgaagagaccacagaaatggtgtcagcagtctcccagttaaccgactccccagacaccacagaggaggccactccggtgcaggaggtggaaggtggcgtacctgacatagaagagcaagagaggcggactcaagaggtcctccaggcagtggcagaaaaagtgaaagaggaatcccagctgcctggcaccggtgggccagaagatgtgcttcagcctgtgcagagagcagaggcagaaagaccagaagagcaggctgaagcgtcgggtctgaagaaagagacggatgtagtgttgaaagtagatgctcaggaggcaaaaactgagccttttacacaagggaaggtggtggggcagaccaccccagaaagctttgaaaaagctcctcaagtcacagagagcatagagtccagtgagcttgtaaccacttgtcaagccgaaaccttagctggggtaaaatcacaggagatggtgatggaacaggctatcccccctgactcggtggaaacccctacagacagtgagactgatggaagcacccccgtagccgactttgacgcaccaggcacaacccagaaagacgagattgtggaaatccatgaggagaatgaggtcgcatctggtacccagtcagggggcacagaagcagaggcagttcctgcacagaaagagaggcctccagcaccttccagttttgtgttccaggaagaaactaaagaacaatcaaagatggaagacactctagagcatacagataaagaggtgtcagtggaaactgtatccattctgtcaaagactgaggggactcaagaggctgaccagtatgctgatgagaaaaccaaagacgtaccatttttcgaaggacttgaggggtctatagacacaggcataacagtcagtcgggaaaaggtcactgaagttgcccttaaaggtgaagggacagaagaagctgaatgtaaaaaggatgatgctcttgaactgcagagtcacgctaagtctcctccatcccccgtggagagagagatggtagttcaagtcgaaagggagaaaacagaagcagagccaacccatgtgaatgaagagaagcttgagcacgaaacagctgttaccgtatctgaagaggtcagtaagcagctcctccagacagtgaatgtgcccatcatagatggggcaaaggaagtcagcagtttggaaggaagccctcctccctgcctaggtcaagaggaggcagtatgcaccaaaattcaagttcagagctctgaggcatcattcactctaacagcggctgcagaggaggaaaaggtcttaggagaaactgccaacattttagaaacaggtgaaacgttggagcctgcaggtgcacatttagttctggaagagaaatcctctgaaaaaaatgaagactttgccgctcatccaggggaagatgctgtgcccacagggcccgactgtcaggcaaaatcgacaccagtgatagtatctgctactaccaagaaaggcttaagttccgacctggaaggagagaaaaccacatcactgaagtggaagtcagatgaagtcgatgagcaggttgcttgccaggaggtcaaagtgagtgtagcaattgaggatttagagcctgaaaatgggattttggaacttgagaccaaaagcagtaaacttgtccaaaacatcatccagacagccgttgaccagtttgtacgtacagaagaaacagccaccgaaatgttgacgtctgagttacagacacaagctcacgtgataaaagctgacagccaggacgctggacaggaaacggagaaagaaggagaggaacctcaggcctctgcacaggatgaaacaccaattacttcagccaaagaggagtcagagtcaaccgcagtgggacaagcacattctgatatttccaaagacatgagtgaagcctcagaaaagaccatgactgttgaggtagaaggttccactgtaaatgatcagcagctggaagaggtcgtcctcccatctgaggaagagggaggtggagctggaacaaagtctgtgccagaagatgatggtcatgccttgttagcagaaagaatagagaagtcactagttgaaccgaaagaagatgaaaaaggtgatgatgttgatgaccctgaaaaccagaactcagccctggctgatactgatgcctcaggaggcttaaccaaagagtccccagatacaaatggaccaaaacaaaaagagaaggaggatgcccaggaagtagaattgcaggaaggaaaagtgcacagtgaatcagataaagcgatcacaccccaagcacaggaggagttacagaaacaagagagagaatctgcaaagtcagaacttacagaatcttaaaacatcatgcagttaaactcattgtctgtttggaagaccagaatgtgaagacaagtagtagaagaaaatgaatgctgctgctgagactgaagaccagtatttcagaactttgagaattggagagcaggcacatcaactgatctcatttctagagagcccctgacaatcctgaggcttcatcaggagctagagccatttaacatttcctctttccaagaccaacctacaattttcccttgataaccatataaattctgatttaaggtcctaaattcttaacctggaactggagttggcaatacctagttctgcttctgaaactggagtatcattctttacatatttatatgtatgttttaagtagtcctcctgtatctattgtatatttttttcttaatgtttaaggaaatgtgcaggatactacatgctttttgtatcacacagtatatgatggggcatgtgccatagtgcaggcttggggagctttaagcctcagttatataacccacgaaaaacagagcctcctagatgtaacattcctgatcaaggtacaattctttaaaattcactaatgattgaggtccatatttagtggtactctgaaattggtcactttcctattacacggagtgtgctaaaactaaaaagcattttgaaacatacagaatgttctattgtcattgggaaatttttctttctaacccagtggaggttagaaagaagttatattctggtagcaaattaactttacatcctttttcctacttgttatggttgtttggaccgataagtgtgcttaatcctgaggcaaagtagtgaatatgttttatatgttatgaagaaaagaattgttgtaagtttttgattctactcttatatgctggactgcattcacacatggcatgaaataagtcaggttctttacaaatggtattttgatagatactggattgtgtttgtgccatatttgtgccattcttttaagaacaatgttgcaacacattcatttggataagttgtgatttgacgactgatttaaataaaatatttgcttcacttagatttgctggttttattagataccaggaagcctgggacatatgtgtaccacattagaattctaaagataatgattgataagctagaactttctgatgtagtcattacatgaaaccccttgtcactggtttgtgtgttcagaggaagccatggccgagatagctttcctgaaataaaccagtagcttttcagattgacgttcttgctacaattgtaccatctggtaattcctgaaaatgtcaatttttttgtgttaatatttttggtttcaaacaataacaaatgtctctagaaagaaattttaagaaagcttaattaatagtaaaaatgcctttcctgaaataatcttggaaaattttttaaatgtcaaaatgatgagtcatgctaatacattgagggtttgtttttttgtttgtttgtttgtttgtttttgagacagagtttcgctcttgttgcccaggctggagtgcaatggcacgatctcagctcaccgcaacctccacctcccggattccagcgattctcctgcctcagcctacattaagggttttgtcagacaattgtcacacgaagaatagtgtcacttatctactcttgacacacagaactggcctggcatatagctttccagattttactcaaacttggtactccagtttgaaaatttaaattttgactgctgattagctggaaagcctagttttaatggaaagaaagtttgcttttaaaactgaaagtagtttctttttgctaacaaatctaacttcatacataattggccatattagtaaaacacctcatgatagcagtgtatatatagtcttgtttgtagttggaagtcatcttttaggagttattctcaaatatatataatagctacccatgcatcattattaaaatccccaaattcaaaaaacctctgatatatatatataatttttttttttttttttttttggccaactgagattgaaatccaagtgctggtttctagttctgaacatcaactaaagagttttggaaatgacagcaatttataacaagttcatattgacttcctctctatggcaggaagacattctgtgctgttttgaacagattaaagatttgtgtagtttgtgggaaattgacgtttttgtttaaattccacccgcgtttgtcttttcctaccacctgtggccaggtgctcgctggccatcacagttgcgattccatgagtagctgctttatgactgctttttgtactatctggatgtgcccagagttacttctgtacaagctctgtatctatgtccgttgagaacattattttaacaagaagaacaccaacagtagcatgaaatataatactgttttataattctaaagctgctgttaatttatgaagtacataataatctaatgtaaactgcagaagtcagagcaagtgcctacattttgttatttttggcattactacagagccatgtacaatagaaagcaatgcaagacttgtaaactctcaccacttcttgtaatatcaaatgttccccctcaggttattttgcttatggtacccatgagttgcctctctctgtacatagataaattgttccaatattttcctttgatgtttggaactacagatagtcaagggctggaaattttagttttcaatataagcttccagcttagcaattacctctagtcgaagacaatatttgattcctagttctgtttggggcaaattttcatttatctaaataaaatgcaatctaattaaatgccatggattttctttctgtaa

SEQ ID NO: 176 - DNA, 2522 bp, Homo sapiens
ctgccaccatgtgaagaaggatgtggttgcttccccttccaccataactgatggaccccttcgaggacacgctgcggcggctgcgtgaggccttcaactgagggcgcacgcggccggccgagttccgggctgcgcagctccagggcctgggccacttccttcaagaaaacaagcagcttctgcgcgacgtgctggcccaggacctgcataagccagctttcgaggcagacatatctgagctcatcctttgccagaacgaggttgactacgctctcaagaacctgcaggcctggatgaaggatgaaccacggtccacgaacctgttcatgaagctggactcggtcttcatctggaaggaaccctttggcctggtcctcatcatcgcaccctggaactacccactgaacctgaccctggtgctcctggtgggcgccctcgccgcagggagttgcgtggtgctgaagccgtcagaaatcagccagggcacagagaaggtcctggctgaggtgctgccccagtacctggaccagagctgctttgccgtggtgctgggcggaccccaggagacagggcagctgctagagcacaagttggactacatcttcttcacagggagccctcgtgtgggcaagattgtcatgactgctgccaccaagcacctgacgcctgtcaccctggagctggggggcaagaacccctgctacgtggacgacaactgcgacccccagaccgtggccaaccgcgtggcctggttctgctacttcaatgccggccagacctgcgtggcccctgactacgtcctgtgcagccccgagatgcaggagaggctgctgcccgccctgcagagcaccatcacccgtttctatggcgacgacccccagagctccccaaacctgggccacatcatcaaccagaaacagttccagcggctgcgggcattgctgggctgcggccgcgtggccattgggggccagagcaacgagagcgatcgctacatcgcccccacggtgctggtggacgtgcaggagacggagcctgtgatgcaggaggagatcttcgggcccatcctgcccatcgtgaacgtgcagagcgtggacgaggccatcaagttcatcaaccggcaggagaagcccctggccctgtacgccttctccaacagcagccaggttgtgaaccagatgctggagcggaccagcagcggcagctttggaggcaatgagggcttcacctacatatctctgctgtccgtgccattcgggggagtcggccacagtgggatgggccggtaccacggcaagttcaccttcgacaccttctcccaccaccgcacctgcctgctcgccccctccggcctggagaaattaaaggagatccactacccaccctataccgactggaaccagcagctgttacgctggggcatgggctcccagagctgcaccctcctgtgagcgtcccacccgcctccaacgggtcacacagagaaacctgagtctagccatgaggggcttatgctcccaactcacattgttcctccagaccgcaggttcccccagcctcaggttgctggagctgtcacatgactgcatcctgcctgccagggctgcaaagcaaggtcttgcttctatctgggggacgctgctcgagagaggccaagaggccgcagaacatgccaggtgtcctcactcaccccaccctccccaattccagccctttgccctctcggtcagggttggccaggcccagtcacaggggcagtgtcaccctggaaaatacagtgccctgccttcttaggggcatcagccctgaacggttgagagcgtggagccctccaggcctttgctctcccctctaggcacacgcgcacttccatctctgccccatcccaactgcaccagcactgcctcccccagggatcctctcacatcccacactggtctctgcaccacccctctggttcacaccgcaccctgcactcacccacagcagctccatccactgggaaaactggggtttgcatcactccactgcacagtgttagtgggacctgggggcaagtcccttgacttctctgagcctcagtttccttatgtgaaagttgctggaaccaaaatggagtcacttatgccaaactctaataaaatggagtcggggggccacatagaagccctcacacacacatgcccgtaacaggatttatcacaagacacgcctgcatgtagaccagacacagggcgtatggaaagcacgtcctcaagactgtagtattccagatgagctgcagatgcttacctaccacggccgtctccaccagaaaaccatcgccaactcctgcgatcagcttgtgacttacaaaccttgtttaaaagctgcttacatggacttctgtcctttaaaagcttccccttggctgtggccctctgtgtatgcctgggatccttccaagcactcatagcccagataggaatcctctgctcctcccaaataaattcatctgttctggaaaaaaaaaaaaaaaaaaa

SEQ ID NO: 177 - DNA, 4202 bp, Homo sapiens
cttttcttcagcgtcctacccgcggcactggctgcgagcgccgggccacctgcgagtgtgcgcagggactctggacacccgcggcggcgagctgagggagcagtctccacgaggacccaggcggaccctctggcgccatgcgcgccctccccggcctgctggaggccagggcgcgtacgccccggctgctcctcctccagtgccttctcgctgccgcgcgcccaagctcggcggacggcagtgccccagattcgccttttacaagtccacctctcagagaagaaataatggcaaataacttttccttggagagtcataacatatcactgactgaacattctagtatgccagtagaaaaaaatatcactttagaaaggccttctaatgtaaatctcacatgccagttcacaacatctggggatttgaatgcagtaaatgtgacttggaaaaaagatggtgaacaacttgagaataattatcttgtcagtgcaacaggaagcaccttgtatacccaatacaggttcaccatcattaatagcaaacaaatgggaagttattcttgtttctttcgagaggaaaaggaacaaaggggaacatttaatttcaaagtccctgaacttcatgggaaaaacaagccattgatctcttacgtaggggattctactgtcttgacatgtaaatgtcaaaattgttttcctttaaattggacctggtacagtagtaatgggagtgtaaaggttcctgttggtgttcaaatgaataaatatgtgatcaatggaacatatgctaacgaaacaaagctgaagataacacaacttttggaggaagatggggaatcttactggtgccgtgcactattccaattaggcgagagtgaagaacacattgagcttgtggtgctgagctatttggtgcccctcaaaccatttcttgtaatagtggctgaggtgattcttttagtggccaccattctgctttgtgaaaagtacacacaaaagaaaaagaagcactcagatgaggggaaagaatttgagcagattgaacagctgaaatcagatgatagcaatggtatagaaaataatgtccccaggcatagaaaaaatgagtctctgggccagtgaatacaaaacatcatgtcgagaatcattggaagatatacagagttcgtatttcagctttgtttatccttcctgttaagagcctctgagtttttagttttaaaaggatgaaaagcttatgcaacatgctcagcaggagcttcatcaacgatatatgtcagatctaaaggtatattttcattctgtaattatgttacataaaagcaatgtaaatcagaataaatatgttagaccagaataaaattaattatattctggtcttcaaaggacacacagaacagatatcagcagaatcacttaatacttcatagaacaaaaatcactcaaaacctgtttataaccaaagaattcatgaaaaagaaagcctttgccatttgtcttagaaagttattttttaaaaaaaaatcatacttactattagtatctatggaagtatatgtaacaatttttatgtaaaggtcatctttctgtgatagtgaaaaaatatgtctttactaagttgaaatgaatactttctgcctttgctaatgatagttattctacaatctccacaagaaaaatataccttttatccggaaatattggtttaaggcaaataaataaaactgtgcttgctctaaagctctgcactacaaaagcaaattttccagtctttattccactcataaccactgctttccccaccaggctaaagtgcttcttagtcttaaatagggtttttaacttcataaggtacaccattgtttatgttttagggtgcaggtccatatagtcgtaatacttaaaacactgctacactgatgcttttgtggctcatggtttcctggttctttgatttaacacctggcttcctggtatctatggctggttaaatatctaaacctgcattattagtgctttacaataataattcccttgactgaagtccagaaatactaaagcacttcttttttattgctgtgaatgccttagacttatcttccaaaataggatacttcgtttctattgcatatataactgaaatattttataaactcactgtaatcaaatcttataaaatctgaatcaacatgaaaagttgtcaatgcttgaatgaatactaaaatcataccacaagatactagataacataaatgaccatgaagtgtcccactgctcaaagggcaacaactttaagaacagaagcaaagagtggtggtgtggaacccaagattcttggcgactagggaatttaaaggttggggaggaggaattcaatgatttgacaagaaatactttataaaaatttgctccatgtattggctaagaaaaatataataaaattttggtagtgaaaattgtatcactaatgtttaccaatattactagtatgaataatacacataaggtagtgacttggaagctgctcaatactttgttgctataacaaaatgcaatattttgttgtaaagcatcttaactacacatataagtttgctgaacttgaatacatcccggtaatggcaaacttcattttattcttggttttcattttattctggtctcagggccatacatttattttagtttaattaattattattttgacaacattacttgggtaatatctatataatggtagataaccaatcagttagcttaattaatctaagctatttgaattcagggaaatattagtcaaatctgctgtttgactaaatacaattcaaagcagtgtatttgtgacttggaatatagaacacaaacaaatgtgtaacccatctgcagtatgcattcttccattttaccaccactaaccattgaggctcatacaattttcaagcaacaagcattgcttcccaaaggtaaaataatcaggaatatttctatagtaaatggagtttttaattggcaatactgtttatttttttctagcaaagacaatttatctcagtaaccttaaataggaaaagtactcaaaaattaaagttgacttttggctttttgtagtctctctggaggacttccagaaaattaccactgttggattttaatctgcttccattaaccaatcttacagagatgataaatgaattaactaatattgaccaaatataaattgactgcaaataataagccgcataaaagttgaagtaggaaaactactccaagtttatatattaggcaccttggggaattctcttagtctttccagctaacaaggattttcagcataataagtagatttaatgatggcataaaattcccagatactttcatatacattttttgccaaagtgtaaatcttctccttttgcagtctttttgttattatcccaacatctagctgctcaggccctaatttagaactcattctgatattttcttcttctgtattaattaatacttatgggtcatgaatccctgctcctttgacctttttaatagctcatgaatccatcccattgcctccccaactctgcccacacctgctgcaacactaatgccttgattttcctacctcagtctccttttctattaatccctcttttgcgtggctgcctgagtccactttctcaaacacaaacctcactatgcaactttggaatctctgtaggctcacctttgccatttcttaatattgcattctccaaattgctaatctctatccagtctcttgaactagacttggcacatggagattccgctcagaaagtgctcttcacacttctacctgcttgactaaccccagattatctttcaagactttaatctgatcttgtgtcttagagaagcccccatacctggtagagcatgtaccatcttacatgcttaaataactccacatttatttgtgtttattactctgtgttataaatatacatttgttggtctctctcttggattattttgtttctttgtcctgtaactaccactgaaagggtgcaatacagctttcttgaaatgtgtattgaacggatgaatgtataaataaaaattaaattttgtaaatttctgcttattcttagaaaaagaatctaaattgtgacaaatcagaattgaaaaaagtattctaataaagaaaaacaagcttttataacttca

SEQ ID NO: 178 - DNA, 4108 bp, Homo sapiens
agtttccttcagcggggcactgggaagcgccatggcactgcagggcatctcggtcgtggagctgtccggcctggccccgggcccgttctgtgctatggtcctggctgacttcggggcgcgtgtggtacgcgtggaccggcccggctcccgctacgacgtgagccgcttgggccggggcaagcgctcgctagtgctggacctgaagcagccgcggggagccgccgtgctgcggcgtctgtgcaagcggtcggatgtgctgctggagcccttccgccgcggtgtcatggagaaactccagctgggcccagagattctgcagcgggaaaatccaaggcttatttatgccaggctgagtggatttggccagtcaggaagcttctgccggttagctggccacgatatcaactatttggctttgtcaggtgttctctcaaaaattggcagaagtggtgagaatccgtatgccccgctgaatctcctggctgactttgctggtggtggccttatgtgtgcactgggcattataatggctctttttgaccgcacacgcactggcaagggtcaggtcattgatgcaaatatggtggaaggaacagcatatttaagttcttttctgtggaaaactcagaaattgagtctgtgggaagcacctcgaggacagaacatgttggatggtggagcacctttctatacgacttacaggacagcagatggggaattcatggctgttggagcaatagaaccccagttctacgagctgctgatcaaaggacttggactaaagtctgatgaacttcccaatcagatgagcatggatgattggccagaaatgaagaagaagtttgcagatgtatttgcagagaagacgaaggcagagtggtgtcaaatctttgacggcacagatgcctgtgtgactccggttctgacttttgaggaggttgttcatcatgatcacaacaaggaacggggctcgtttatcaccagtgaggagcaggacgtgagcccccgccctgcacctctgctgttaaacaccccagccatcccttctttcaaaagggatcctttcataggagaacacactgaggagatacttgaagaatttggattcagccgcgaagagatttatcagcttaactcagataaaatcattgaaagtaataaggtaaaagctagtctctaacttccaggcccacggctcaagtgaatttgaatactgcatttacagtgtagagtaacacataacattgtatgcatggaaacatggaggaacagtattacagtgtcctaccactctaatcaagaaaagaattacagactctgattctacagtgatgattgaattctaaaaatggttatcattagggcttttgatttataaaactttgggtacttatactaaattatggtagttattctgccttccagtttgcttgatatatttgttgatattaagattcttgacttatattttgaatgggttctagtgaaaaaggaatgatatattcttgaagacatcgatatacatttatttacactcttgattctacaatgtagaaaatgaggaaatgccacaaattgtatggtgataaaagtcacgtgaaacagagtgattggttgcatccaggccttttgtcttggtgttcatgatctccctctaagcacattccaaactttagcaacagttatcacactttgtaatttgcaaagaaaagtttcacctgtattgaatcagaatgccttcaactgaaaaaaacatatccaaaataatgaggaaatgtgttggctcactacgtagagtccagagggacagtcagttttagggttgcctgtatccagtaactcggggcctgtttccccgtgggtctctgggctgtcagctttcctttctccatgtgtttgatttctcctcaggctggtagcaagttctggatcttatacccaacacacagcaacatccagaaataaagatctcaggaccccccagcaagtcgttttgtgtctccttggactgagttaagttacaagcctttcttatacctgtctttgacaaagaagacgggattgtctttacataaaaccagcctgctcctggagcttccctggactcaacttcctaaaggcatgtgaggaaggggtagattccacaatctaatccgggtgccatcagagtagagggagtagagaatggatgttgggtaggccatcaataaggtccattctgcgcagtatctcaactgccgttcaacaatcgcaagaggaaggtggagcaggtttcttcatcttacagttgagaaaacagagactcagaagggcttcttagttcatgtttcccttagcgcctcagtgattttttcatggtggcttaggccaaaagaaatatctaaccattcaatttataaataattaggtccccaacgaattaaatattatgtcctaccaacttattagctgcttgaaaaatataatacacataaataaaaaaatatatttttcatttctatttcattgttaatcacaactacttactaaggagatgtatgcacctattggacactgtgcaacttctcacctggaatgagattggacactgctgccctcattttctgctccatgttggtgtccatatagtacttgattttttatcagatggcctggaaaacccagtctcacaaaaatatgaaattatcagaaggattatagtgcaatcttatgttgaaagaatgaactacctcactagtagttcacgtgatgtctgacagatgttgagtttcattgtgtttgtgtgttcaaatttttaaatattctgagatactcttgtgaggtcactctaatgccctgggtgccttggcacagttttagaaataccagttgaaaatatttgctcaggaatatgcaactaggaaggggcagaatcagaatttaagctttcatattctagccttcagtcttgttcttcaaccatttttaggaactttcccataaggttatgttttccagcccaggcatggaggatcacttgaggccaagagttcgagaccagcctggggaacttggctggacctccgtttctacgaaataaaaataaaaaaattatccaggtatggtggtgtgtgcctgtagtcctatctactcaagggtggggcaggaggatcacttgagcccaggaatttgaggccacagtgaattaggattgcaccactgcactctagcccaggcaacagaacaagaacctgtctctaaataaataaataaaaataataataataaaaaagatgttttccctacaactcagacttttcatttgaactcggtccagcaaggaaaatataacccactcgaagtctttaaaacagaggaaatttaatataaagaattccactggtgacgaaagagcagagaagcccagaagatagtgaggcaaccctgataggaacataactaggaagccaagaccactcctatggttgcaggggtgatgggaaagctggtgtacttggacccagaagccaaagttgctgcacccaccttggagacatagacactggcagtaatacctcagggagaagaaagaaatctagggaaatatcctggcttctttccttctctctctcccctagtcttcctaccagtgtctcccattagccaaatctacctagaagccagaaaacaagggaaccctggaaatgtagccccataagataaagagcaccaaaggaaatagatctgagcagacaggcagcacaaaatgcagtgtgtatggtttattcactcagtaattcctttagcaaatgtttattgaggatctactaggtgccaggtatcatgatacttgctggggataccataatgaacaaaacagacctgttctccgctcttgaggaaatcaaagacaaacacaggatatggaataaacccagaattatctcattgtaaaatgtgttaagtaccacgaggagaaatatcagggcgatctgacacagctaatgatttgaagaagggtgtgacctgccaccattttaaatctagttatttcactcctgagctgtgtgtgtggaaaacttgtagtaaaaaatagaatgtctatatttataaaaagtttatgaaaaga

SEQ ID NO: 179 - DNA, 1401 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagacaa

SEQ ID NO: 180 - DNA, 2230 bp, Homo sapiens
agggaagcttggttaaaaacagttatggcagtgggagtcgaagcgagggtctgaagttcacgactactagaaggggaggggagtggaaaggctctcagtgaaaaaggtatggaacccttcagatcaaagcttaccaataaattcagtatgtagaacagattaacgtagttgaaatgaggaagaatgagagttatctcaaccagccagcaccccctatccccattcccacactttccctcatgggaggctgtcgggagcacttcgaaaaccactggaaaggccgggcacggtggctcatgcctgtaatcccagcactttgggaggccaaggcaggcagatcacctgaggtcaggagttcgaaaccagcctggccaacatggcgaaaccccatctttactaaaaatacgaaaattagccaggtattagaattatttctgaattatcagtctctcatttgtgctttggagaagcagaaaaggcaaaaggggtctttggccatcttctgctggagcttccagggaggatgtgtctccaagagaccagatgtaccgagtttgaaatcccagaagcccaagaggaaaagaatcacagggaggaaaagactgtccaaaggcttctggagtcttctgttctctaaccttggaaggttttgaacaatatttctcagaggatagcctttcacttattcatctgtccagcatgactcatccccgggagtgttgagtaagtgaaattttgctgtattcatgtttttgtgacttataaaataggatgataaggagagaacatgaactctggagtcagacctgttacctcggacatgatactcttagctttgtcatttagtatttgagtaattttgggcaagctaacatctctggtcgttctcatctgtaaaatgagaataaatgaaacccactaaccagaattggtatgaaaatgaaatgtggcagaaaaaaaatgaaagtgaatagtatcaccactgacacacaagcactaaaggcccttcctgtctccatcaggtatggatttggggcaacatttggccaggtcttgtttatctttctgttcatctattctgtctaattcagtgctttgtttacaacgaatgtcttacaaatgctgactgaacactagcatacctgcatgaacaacaggtaaataaattttagatgtgttttaatgtttattaatctatcctgtcagagaagaactgccagttatagataaatatgatgccaggtcagggctgaagagttgggcaggttgttatctgcatggggtcactaggttccagtggagaggtgggggctaagctctcacccgctctgcagccacctggcacccggtttcagtttcctgaaagggagccttctacttgctgacgactgcctcatctcttctgaggtttcctctgataaacaattttctctgctttttttttttaattatgaaatacttaaaatgtaaaggagataatgtgacacacatttacccataattgagattgccataattgctataactttttcaaaattttgacttaatttcagacttttagaaaaattggccaggtgtgatggctcatgcctgtaatcccagcactttgggaggccaaggtgggtaaattacttgaacccagcagttcgagacttgcctgggcaacatagtgagaccttgtctctactgaaaacaaactaaaaaaaaaattagccaaccatggtggtgcatgcctgtagtcctagctactcgggaagctgaggcaagaggatagcctgagcccaggggagttggggctgaagcctgggtgacagaggaagaccttgccttcaaaaaaacaaaaaaaaagaaaagaaattctttatattacaaagaattcccatataccttccacagtttcccaaatgttaatattttcccacatttgctttatccttgtctcttgatattacatatgctggttatatttttctgaaccatttaggagaaatttgcatacatgatgactgtttcctcctaaatactccagttcttattttctaaaaataaggacattctcttacacaaccacagaacaattatcaaaagcttggaaactaacattgatacaatactttaatctacatacctcattcagatttcaccagttgtcctaataatgtaataaaattatttctggattatgtctatctcatttatagtaaaagaaaatcctggatcatgcattgca

SEQ ID NO: 181 - DNA, 974 bp, Homo sapiens
agctttggggttgtccctggacttgtcttggttccagaacctgacgacccggcgacggcgacgtctcttttgactaaaagacagtgtccagtgctccagcctaggagtctacggggaccgcctcccgcgccgccaccatgcccaacttctctggcaactggaaaatcatccgatcggaaaacttcgaggaattgctcaaagtgctgggggtgaatgtgatgctgaggaagattgctgtggctgcagcgtccaagccagcagtggagatcaaacaggagggagacactttctacatcaaaacctccaccaccgtgcgcaccacagagattaacttcaaggttggggaggagtttgaggagcagactgtggatgggaggccctgtaagagcctggtgaaatgggagagtgagaataaaatggtctgtgagcagaagctcctgaagggagagggccccaagacctcgtggaccagagaactgaccaacgatggggaactgatcctgaccatgacggcggatgacgttgtgtgcaccagggtctacgtccgagagtgagtggccacaggtagaaccgcggccgaagcccaccactggccatgctcaccgccctgcttcactgccccctccgtcccaccccctccttctaggatagcgctccccttaccccagtcacttctgggggtcactgggatgcctcttgcagggtcttgctttctttgacctcttctctcctcccctacaccaacaaagaggaatggctgcaagagcccagatcacccattccgggttcactccccgcctccccaagtcagcagtcctagccccaaaccagcccagagcagggtctctctaaaggggacttgagggcctgagcaggaaagactggccctctagcttctaccctttgtccctgtagcctatacagtttagaatatttatttgttaattttattaaaatgctttaaaaaaataaaa

SEQ ID NO: 182 - DNA, 6582 bp, Homo sapiens
gggatagctgtccaaggtctcccccagcactgaggagctcgcctgctgccctcttgcgcgcgggaagcagcaccaagttcacggccaacgccttggcactagggtccagaatggctacaacagtccctgatggttgccgcaatggcctgaaatccaagtactacagactttgtgataaggctgaagcttggggcatcgtcctagaaacggtggccacagccggggttgtgacctcggtggccttcatgctcactctcccgatcctcgtctgcaaggtgcaggactccaacaggcgaaaaatgctgcctactcagtttctcttcctcctgggtgtgttgggcatctttggcctcaccttcgccttcatcatcggactggacgggagcacagggcccacacgcttcttcctctttgggatcctcttttccatctgcttctcctgcctgctggctcatgctgtcagtctgaccaagctcgtccgggggaggaagcccctttccctgttggtgattctgggtctggccgtgggcttcagcctagtccaggatgttatcgctattgaatatattgtcctgaccatgaataggaccaacgtcaatgtcttttctgagctttccgctcctcgtcgcaatgaagactttgtcctcctgctcacctacgtcctcttcttgatggcgctgaccttcctcatgtcctccttcaccttctgtggttccttcacgggctggaagagacatggggcccacatctacctcacgatgctcctctccattgccatctgggtggcctggatcaccctgctcatgcttcctgactttgaccgcaggtgggatgacaccatcctcagctccgccttggctgccaatggctgggtgttcctgttggcttatgttagtcccgagttttggctgctcacaaagcaacgaaaccccatggattatcctgttgaggatgctttctgtaaacctcaactcgtgaagaagagctatggtgtggagaacagagcctactctcaagaggaaatcactcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagtgggacaaatgcagccgggcggcagatctagcgggagctcaaagggatgtgggcgaaatcttgagtcttctgagaaaactgtacaagacactacgggaacagtttgcctccctcccagcctcaaccacaattcttccatgctggggctgatgtgggctagtaagactccagttcttagaggcgctgtagtatttttttttttttgtctcatcctttggatacttcttttaagtgggagtctcaggcaactcaagtttagacccttactctttttgtttgttttttgaaacaggatcttgctctgtcacccaggcttgagtgcagtggtgcgatcacagcccagtgcagcctcgaccacctgtgctcaagcaatcctcccatctccatctcccaaagtgctgggatgacaggcgtgagccacagctcccagcctaggcccttaatcttgctgttattttccatggactaaaggtctggtcatctgagctcacgctggctcacacagctctaggggcctgctcctctaactcacagtgggttttgtgaggctctgtggcccagagcagacctgcatatctgagcaaaaatagcaaaagcctctctcagcccactggcctgaatctacactggaagccaacttgctggcacccccgctccccaacccttcttgcctgggtaggagaggctaaagatcaccctaaatttactcatctctctagtgctgcctcacattgggcctcagcagctccccagcaccaattcacaggtcacccctctcttcttgcactgtccccaaacttgctgtcaattccgagatctaatctccccctacgctctgccaggaattctttcagacctcactagcacaagcccggttgctccttgtcaggagaatttgtagatcattctcacttcaaattcctggggctgatacttctctcatcttgcaccccaacctctgtaaatagatttaccgcatttacggctgcattctgtaagtgggcatggtctcctaatggaggagtgttcattgtataataagttattcacctgagtatgcaataaagatgtggtggccactctttcatggtggtggcagcagttaccagtaatgagcattagactctgggggatagaacacgggctgccctgagagcttcatgttggagctgaagttcaaggttcacttcctttgggtttgtacttgacccttcttcatgtgtctctcccgttccctctaaaacaagtgtgtttcccctcatttttgaggctgtcaatggtgtgagagccaggatcatcacggggcctgaggttttactccagaaaagcagaggagtggcaaccttggcttggggtttggcagcccaggaaaggcagggaggagagctcaaagccggtttcatgtttcacccaaggtctaattgtgggagaggacaaatccagatcccctgtttgacagaattagttcacaaatgtctcttggcaaaaacatgtgacacctaaccatgataattgacttaatccaagaaagagctctgtagggcagagcaataggaaatctctctttcgttatggaaaaaaaataatccctctacatagaaactgagtgacatgtaaaaatgtgtagctaagtcagggagttacttcctaagagcctgacgctctgcttttcatcaaaaggaaaaaccagcgtgaggcagaggcgagggaggtggaggtgagtggatgatgtgctgagttagggatgtttatatgccgcaaaggtttggttggtaggcttcgcgctaagattagcctggctttgtactgaaaagggggaaggacacatagtgacacagatccttctggtctttcccaggaggtgtgacctaatgaggtttgttgtgagaataaagcaatgtggtttcacatatattatctatcataggctagggactcaagaaatgcatattccccccccactttctttctctctttccttccttccttcctttcttctttctttctttctttctttctttctttctttctttctttctttctctctctctctctctctctctttctttctttctttttgagatagagtctcactctgtcatccaggctggagtgcagtggcatgatctcagctcactgcagcctccgcatcctgggttcaagcgattttcgtgcctcggccttctgagtagctgggattacaggcgtgcgtgcgccaccacgcctggctaatttttgtatttttagtacagacgaggtttcaccatgttgaccaggctggtcttgaactcctgatcttaagtgatctgcccgccttggcctcccaaagtgctgggattacgggtgggaatcaccatgcccagcctcctttccatcttttctttccttctctggtcttcatactaccaaccaagcaagggaggaggagtaaaaggtaaaatcacaaaatactctggatcggcatttttttttttttttttttttgagacagggtctagctctatggcccaggctggagtgcagtggcacaatcatagctcactgcagcctcaactttctgtgctcgagtgattctcctgcctcagtctcctgagtagctgggaccacagacgtgcactaccacacttggctaattttattttttcagagatcacatgtggtttgagggaggatagagaggacagggtgtcaagaacagcatttttaccaagttgatataaaaatgaaacaggatccaggcatgggtctttacactgatagttacagtaagttttaaaatctgagcagcaatttgaatcacttgttgaaaaacacacaaaatatattttttgtagaggtgggggtcttgctctgttgcccaggctggtcttgaactcgagattctcctgctttggcctcccacaagtgctgggattacaggcgtgagctactgcacccggcctgctttctttttagtgaaaaggatctgtgggagcttttattcccatggctgccttcctcaagtcaacctctttccccggaaatggcatcatctctggactgttgtttctccttcttccttctcctccttctcctcctcctcctcctccaccatgcccggctgatttttgtatttttagtagagacagggtttcactatatgggccaggcagatctcgaactccaaacctcgtgatccacctaccttggcctctgaaagtgctgggataccgtggcctctgaaagtgctgggattacaggcatgagccaccgcgcccggccccgttgtttcccttctaagaaacgcagtggtctctgaagcctgcaggggcaggccagccctgcactgaacgcctgttcttgccaggtggcagaaggttgctgctcatttgagcagtacctgtcacccctcctcccactgctgcggctgttaactcatcttcaggtctcacaccttctgcacataaataagctatttttaaaagttattatttttttactctttcttttctttggagagggtaccaaaggatagctgttctgtttaagtagggacctctcatggcctacaggctttgacatctgagaatcaaactggagaacattccgaagccgttcttataagtgtctccatctctacctgggctgaaatggaatgtgcaaatgtagcccagcctggtccttgggtgttgccagttgattgatgactgggagccaaagtggcatctcctttgacctaaacgggcgatgatgaaataaaactcaacagcctttctctcatcttgcattgtgagatgcgaaatagagcgtgtctctctgcctctcattttaggctgaggccgtccaaagcggccatgccccatgtttccactagatggcgctgacacttcaggcatcaaccctcatggcctctcagccttgcaaaggcagccacttaaagtcggtgtcctgtgtggggcaccaagctgagctgcagacacccagtaggcgcgaggcaaatgcgtcccattttaagaggcttgtatttatgagctctttgcttcctccctcccactaactttaaagaattgctctccatctcctttggcaaagttcctttgccctttgtcttatttttgtgaaaccctccaaggtatttccagtccatttgcatccaatctggcatctttacggagagcggtctcatatgctattgttgttaacgtggactagtatttatgtgttgagaacactggctgtttgtcaggaaaagtgtgccaaaacaaagagtacggccggccctggaaatgcatcagcaaaacccatttcccccgtgcactcattctgagcttccttccttcatttctgtcattactgctgagaactggactgtgcccagctgacctttcccttccttgccctcatcttgctgccagggtctgcaggtttgccaccgtcccggccccagtctgaaacatgggattatttcagaattggaggtggcagcttcagaaaaaaatccttctcgtgtgttgactgctgagatccaggaactgggaaatcaacccccagtttgtagattgctctctttggaaattctgtggcccaacctcgtggctgttttctggaattccttctatcggggcagacagtgctgtgcctttcttgacttcaggatgttccaaggatgctgctggatctgtgtgtgtgtgtgtgtgtgtgtgtgtgtgtgtgtgtgtgcgtgcgtgcgtgtatgtgcgcctgaccctgatttctgcaacctccagatttctttcttgacccttcaaagtggaacagtccagtgccaaaaattttagagtttgagaaggtcacagaaatcctctagttggtgcctccacagtcttcattttacagaggaactcagggctaatggagttaatgcaactagatcagggttttgggtctgtgttctttctaccgtcagcacctgtgtggtcaattctggacacttcccagagaagtctttgagtagagaatcctactcaaatttcactgtatattttaagcattcctctcctttccctttgcctcccctgttgccttttcttcccctgatttctcctctggtcatctcctctcccttctgcgtgtaagccatgggaaagggatgagggaggacagcttctggttaaacacaggtccctcttccacatcaaatgaacattggcttcctgggacagaaggccttcaaaggagggattgcaaagcaaggcaaagcgttctgtcttcattttccccatccccatgagacaagactgatggaaagggtggtggggcaacactgcttaatggatgccttttcacatcatttcagtttttagccctcatgactgtattttctaatcagagacaataacattttaaataaaacaacgacaaagaa

SEQ ID NO: 183 - DNA, 1713 bp, Homo sapiens
gagcccgtgtctgtcgggtgccgagccaactttcctgcgtccatgcagccccgccggcaacggctgcctgctccctggtccgggcccaggggcccgcgccccaccgccccgctgctcgcgctgctgctgttgctcgccccggtggcggcgcccgcggggtccggggaccccgacgaccctgggcagcctcaggatgctggggtcccgcgcaggctcctgcagcaggcggcgcgcgcggcgcttcacttcttcaacttccggtccggctcgcccagcgcgctacgagtgctggccgaggtgcaggagggccgcgcgtggattaatccaaaagagggatgtaaagttcacgtggtcttcagcacagagcgctacaacccagagtctttacttcaggaaggtgagggacgtttggggaaatgttctgctcgagtgtttttcaagaatcagaaacccagaccaaccatcaatgtaacttgtacacggctcatcgagaaaaagaaaagacaacaagaggattacctgctttacaagcaaatgaagcaactgaaaaaccccttggaaatagtcagcatacctgataatcatggacatattgatccctctctgagactcatctgggatttggctttccttggaagctcttacgtgatgtgggaaatgacaacacaggtgtcacactactacttggcacagctcactagtgtgaggcagtggaaaactaatgatgatacaattgattttgattatactgttctacttcatgaattatcaacacaggaaataattccctgtcgcattcacttggtctggtaccctggcaaacctcttaaagtgaagtaccactgtcaagagctacagacaccagaagaagcctccggaactgaagaaggatcagctgtagtaccaacagagcttagtaatttctaaaaagaaaaaatgatctttttccgacttctaaacaagtgactatactagcataaatcattcttctagtaaaacagctaaggtatagacattctaataatttgggaaaacctatgattacaagtaaaaactcagaaatgcaaagatgttggttttttgtttctcagtctgctttagcttttaactctggaagcgcatgcacactgaactctgctcagtgctaaacagtcaccagcaggttcctcagggtttcagccctaaaatgtaaaacctggataatcagtgtatgttgcaccagaatcagcattttttttttaactgcaaaaaatgatggtctcatctctgaatttatatttctcattcttttgaacatactatagctaatatattttatgttgctaaattgcttctatctagcatgttaaacaaagataatatactttcgatgaaagtaaattataggaaaaaaattaactgttttaaaaagaacttgattatgttttatgatttcaggcaagtattcatttttaacttgctacctacttttaaataaatgtttacatttctaaataatgaaatgtgttgaatgttctcgtgaagatttgtatacaaaggaaaaatttgtgctaaactggaattaaatgaaatggtaatattgcttaacttaaattttacaaataatagaacgtctgtctcaccagataaagctgtctgcaaacatgcatcaaaagaaacactgatgtaactgaaagtatattaaatatttacaattttcatttacaaggacaa

SEQ ID NO: 184 - DNA, 1054 bp, Homo sapiens
cctcctgtcttgtctcagcggctgccaacagatcatgagccatcagctcctctggggccagctataggacaacagaactctcaccaaaggaccagacacagtgggcaccatgggacagtgtcggtcagccaacgcagaggatgctcaggaattcagtgatgtggagagggccattgagaccctcatcaagaactttcaccagtactccgtggagggtgggaaggagacgctgaccccttctgagctacgggacctggtcacccagcagctgccccatctcatgccgagcaactgtggcctggaagagaaaattgccaacctgggcagctgcaatgactctaaactggagttcaggagtttctgggagctgattggagaagcggccaagagtgtgaagctggagaggcctgtccgggggcactgagaactccctctggaattcttggggggtgttggggagagactgtgggcctggagataaaacttgtctcctctaccaccaccctgtaccctagcctgcacctgtcctcatctctgcaaagttcagcttccttccccaggtctctgtgcactctgtcttggatgctctggggagctcatgggtggaggagtctccaccagagggaggctcaggggactggttgggccagggatgaatatttgagggataaaaattgtgtaagagccaaagaattggtagtagggggagaacagagaggagctgggctatgggaaatgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgattaataaaaaaaaatgaaaaaagtgaaa

SEQ ID NO: 185 - DNA, 1722 bp, Homo sapiens
ggaacagcggcctctgacaccagcacagcaaacccgccgggatcaaagtgtaccagtcggcagcatggctacgaaatgtgggaattgtggacccggctactccacccctctggaggccatgaaaggacccagggaagagatcgtctacctgccctgcatttaccgaaacacaggcactgaggccccagattatctggccactgtggatgttgaccccaagtctccccagtattgccaggtcatccaccggctgcccatgcccaacctgaaggacgagctgcatcactcaggatggaacacctgcagcagctgcttcggtgatagcaccaagtcgcgcaccaagctggtgctgcccagtctcatctcctctcgcatctatgtggtggacgtgggctctgagccccgggccccaaagctgcacaaggtcattgagcccaaggacatccatgccaagtgcgaactggcctttctccacaccagccactgcctggccagcggggaagtgatgatcagctccctgggagacgtcaagggcaatggcaaagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggactgtacgggagccacttatatgtatgggactggcagcgccatgagattgtgcagaccctgtctctaaaagatgggcttattcccttggagatccgcttcctgcacaacccagacgctgcccaaggctttgtgggctgcgcactcagctccaccatccagcgcttctacaagaacgagggaggtacatggtcagtggagaaggtgatccaggtgccccccaagaaagtgaagggctggctgctgcccgaaatgccaggcctgatcaccgacatcctgctctccctggacgaccgcttcctctacttcagcaactggctgcatggggacctgaggcagtatgacatctctgacccacagagaccccgcctcacaggacagctcttcctcggaggcagcattgttaagggaggccctgtgcaagtgctggaggacgaggaactaaagtcccagccagagcccctagtggtcaagggaaaacgggtggctggaggccctcagatgatccagctcagcctggatgggaagcgcctctacatcaccacgtcgctgtacagtgcctgggacaagcagttttaccctgatctcatcagggaaggctctgtgatgctgcaggttgatgtagacacagtaaaaggagggctgaagttgaaccccaacttcctggtggacttcgggaaggagccccttggcccagcccttgcccatgagctccgctaccctgggggcgattgtagctctgacatctggatttgaactccaccctcatcacccacactccctattttgggccctcacttccttggggacctggcttcattctgctctctcttggcacccgacccttggcagcatgtaccacacagccaagctgagactgtggcaatgtgttgagtcatatacatttactgaccactgttgcttgttgctcactgtgctgcttttccatgagctcttggaggcaccaagaaataaactcgtaaccctgtccttca

SEQ ID NO: 186 - DNA, 1347 bp, Homo sapiens
gcagtggttgctgggcgaccacggagagaaagccgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgacgcggcacccgtggacgggcgttggctctgcgtggtgggcggctgggacgggtctcgccgcttggccacagtgaccgcactggacacagagcgcggtgtgtgggaggcgtggacagggacccctggtgactgcccccccgccggcctcagtagtcacacctgcacccgaatctctgaccgagagctgcaggtggctggccgggagggcggtatccacactcagcgacgctatggaagcatctacacattaaggctggaccccagcgcccgcacctattgctacaagcaagaaggctgccacacagcctcacgctcaggtcactgtgcggccctgctccaaactcctggaccccatccaggtcatcagctattgctctttggaggttgcaacttagctgaaccagaagtagctgggcattggagtcatgggaaaattaaggaggaaccacctgttgctcctcatttgatggaacagcttgcaaggcttgtgagcagtgggcaggggtcccagaaggggccccatggactacggcatcactcatgttctgtggtcgggccctttgctgtgctgtttggtggagaaactctgaccagagctagagacaccatctgcaatgatctctacatctatgatactcgcacatctcctcctttgtggttccacttcccctgtgcagatcgtgggatgaaacgcatgggccatcgcacctgcctttggaatgatcagctttacctggttgggggttttggtgaggatggcaggacagccagtccacaggtttgcatcctggactttatctaaatagtgccaagacacatcactaagcctcgttttgttttgctttgttgcaaacctataaagcgttatcaccagagctatctgcttcacttcaaatgcttattaaatttcaatctgagactcaa

SEQ ID NO: 187 - DNA, 1432 bp, Homo sapiens
agcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagataataaaaattgttgcttttgttaaaa

SEQ ID NO: 188 - DNA, 4430 bp, Homo sapiens
agtccacccctggggcgcgcggctgtcacccagggcggggcggcgcgggcgttgccacgacgcgggccgcgcgcgtccctggcagccaacccgtccacgtcaaggtttgtttaataatcgccagggtatctatggccgggctcaggcggctgctggggagccaggagaccgcgcgggacggcggatgaggcgcggcggctgcggcccagggcacctcccctctggcttcccgaacccggccaggtccgacccgagggggaggatggaaacacctgccgcgctctgagccccccagaagagaacacccttcccgccatatcaccccacggtcctgcggaggccaccgcctggtccccccaagtctccatcgcgcagcgtggggccgagaggaatagtgagcgatggcggaaaacctgaaaagactggtctcaaacgaaactttacgaacgttgcaggaaaagctagacttctggctgaaggagtacaacacaaacacgtgtgatcaaaatctaaaccattgccttgaactcattgagcaagttgccaaggtgcagggacaactctttgggatcctcacagcagcagcccaagaaggaggacgtaatgatggtgtggaaacaatcaagtcacgccttttgccttggctggaggcttcctttactgctgcttccctgggaaaatctgttgacagcaaggtcccctctctgcaggacacgtttgatagggagagacataaagatcccagtcctcgggatcgggatatgcaacagttagactctaatttgaactcaacccggagtcaatgcaaccaggttcaagacgatctggttgaaactgaaaagaatcttgaagaaagcaagaacagatcggccatatcccttttggctgcagaggaggaaataaatcagctgaaaaagcagcttaaatctcttcaagctcaggaggatgcccgccacagaaacacagatcagaggagctcagagaataggcggtcagagccttggagcttggaggagcggaagcgtgagcagtggaactcactcaagcagaatgcagaccagcaggacacagaagccatgtccgattataagaaacagctccgaaacctgaaggaggagatagctgttctgtctgctgagaaaagtgcactccaaggaaggtcctccaggagccggtctcccagccctgcccctcgcagccgtagctgcagccgcagcagatctgccagcccctccaccgctgtcaaggtcaggagaccgtccccaaaccgctccaagctgtccaatgtggcgcgcaaggctgccctcttgtcccggttcagcgattcctattcccaggcccgcctggacgcgcagtgcctgctgcggcgctgcatcgacaaggctgagaccgttcagcggatcatctacatcgccacagtggaggcattccatgtagcaaaaatggcattcagacacttcaagatccatgtgagaaaatcgttgacaccatcttatgtggggtcgaatgactttgagaatgctgtcttggattatgtcatttgtcatcttgatctatatgattctcaaagcagtgtcaatgatgtgatccgagccatgaatgtcaatcccaagatttcattccctcctgtcgttgacttttgccttctcagtgacttcatccaggagatatgttgcattgcctttgcaatgcaggccttagaaccacccctagatattgcatatggagcagatggagaagtttttaatgattgcaaataccgccgcagctacgactcggatttcactgctcccttagtcctctatcacgtgtggcctgctctcatggagaatgactgtgtcattatgaagggagaagctgtcaccaggagaggggctttttggaattcggtgcgatctgtaagtcgttgtcgaagcaggagtttaagtcccatttgcccccgtagccaaattggtttaaacacgatgtctcgaagtcggagtccttctccaataagatgtggattgccaagattttaaaagcaccagacctgctcctttgacccagtgcgtggaaacagctgctttctccagtgccgccatctgtcttctgtgtctgcctcagacctcacttaagataatgtcaaaaggcaattctgtgtatcaccccacacagagagttaaatgttttggcttggcgcatttgtaactttagatatattgcattctattttattttatagatactaattccattaatttcataaaaatgattgtataggcatttaggatcatattcattcgaagcaaagtccgttacaaaggttcaagatttccatctcaaaacactacgctcttttatgggaactgtgtgaactgaagtggaaagcatctaccatgctgaggctaaaagaaaagatgaatcattttagtttgcagatggatcgtaaatataattgttggtatcagctttagctcaaaaccaatattaggtgttttaatttccttttaaggtttggaagacagccctaatctcaggttggggagctcatgttagtagcagtgacttaaggctaagtgtagaagataatttaagatacattttctttatatattagccaacaaattatatttattggttggcttgcttttccgttctgattttgagagtgcccagtttggtttagttgaccaatgaatgtcaaagctacttagttgagagaatttccttgttcataaatgtagagcagtgatttgattagaagccagctttgagataaatgttaattacctcatgcatatctcctgggaatatttcaaactgttttaatgcatgtgttatatataaaagtttcttgggacatgctcttcacctgttctacctagttatttgcaaattcagacctcctattgaactctgtctgaccaaaactacttaaactcaaggcccaaaactaggggcaccatttactgattttaaattgagtatatatcccttgacttcttcactgtcaaatacttttgaaacttcacgttcaagataagaatggaatgttgctttcttgcaataagtaatgttctttctgcctttttttcacttttaagtcagccttaaacacatgcctcacaaacatctactttctccacatacctttgagagagacactgaattggcctcagctcagttttgcataagcttagtgccagaaccagcacctgatgcttttcaggtgaaaataaaacaaacagcttctctaaagcatcttacccctgtgctggaggtttgagggacctcttcagtgcctgccccttgagtctaatggtcaccacctcattctgaagtatgagttgaattttttgccctctttgcatatttacattagtcatcactttgaagcaatgcagtgtgctggaaggagcactatctgcctaggtaactgctagtcatgacttggtcatcagcttgctttgtggcactgagcaagttacttcacttctctgagccttggttttatcatagggtgaggaggttggatacaattagtgcccctcttaaccctgcagactcaatgttcccttttataacaagtattttattctgaatatgaaatgaaaattaaagttaatataatcatctatgtgcatgtataattttaagcagtgaacatagtaccctaactataatataaagcagaaaaaaaggcaacttttaataaaataaaatgtatttcaataaaaaagcttgggtataaccaccctagaagataaaattaagtcattagatggctgaacctgcatgtagagccaccagctacaaatgaaaatcaatgtgtgtattggcaacagaaaatcacggtgttgtcattggatgtgactttctgaagtggtgggcaattcttgttaatgttttaaacaaaaaaaaaaaaaccttacagtcttgccctgatttacacagcagtcacattcctggaaaattcaagtgtttattaaaactatgcaacagttactgtgtgttatacgttgaaaggtcttcactaatatctcactaagtaatgagaatgcctacatatcagaattttttttttcaggagccaagcacatatactgatttggaaaaaggcacaggtagctcagtttatttgctttctaccctgcctggccacttgctgtttcttcagtttctaatttgagctgtaactacacaaggaaagctaaatagtctggaaaatttttggaaagaatccacaaagccaaaggagactggcctatactcattttatctggggatgtaccttacccttagagactttgaaaaatgtgaagctcttattttgtaacctgggtaaatgttagtttctagattttcggcttaacatctaataataacatttaaaaagtgcttttgtaactattagttatttgcaataaaatgctttccttctacagtcccaa

SEQ ID NO: 189 - DNA, 514 bp, Homo sapiens
aggcggtcaggggaaggctcaggaggagggagatcaacatcaacctgccccgccccctccccagcctgataaaggtcctgcgggcaggacaggacctcccaaccaagccctccagcaaggattcagagtgcccctccggcctcgccatgaggctcttcctgtcgctcccggtcctggtggtggttctgtcgatcgtcttggaaggcccagccccagcccaggggaccccagacgtctccagtgccttggataagctgaaggagtttggaaacacactggaggacaaggctcgggaactcatcagccgcatcaaacagagtgaactttctgccaagatgcgggagtggttttcagagacatttcagaaagtgaaggagaaactcaagattgactcatgaggacctgaagggtgacatcccaggaggggcctctgaaatttcccacaccccagcgcctgtgctgaggactccctccatgtggccccaggtgccaccaataaaaatcctacagaaaa

SEQ ID NO: 190 - DNA, 8576 bp, Homo sapiens
gcactcgctcacgctgcccctcgcgcacacacatggtcggctcgcggcaaagtttcgcctgcgatcaccactccgggatcctgccgcagtgcttggggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagtttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacaga

SEQ ID NO: 191 - DNA, 10819 bp, Homo sapiens
gcgccaggctgcaggtttgagagccgctctggatgggctcgctagagtcgttgttgtggaagcggtgcatttacagtgcaacagtcagcacattgaaaataccaataggaatacaaaacaaagtcacatttactgatttaattgtattgcattcagttgtatccaggaaacagcctccaaccatggacccgcacagcggccgctggctcggtgcgcggccgcccgccgagaagcccagtcctcccgcgtgctgaccggccccgccgccaccaccgcctgtgaccccggacgccgccgcctctgcgccgcccgcgcgccgagccgcccccgggccccggccgcgctgctccgaggaagcggcggcggaccggggccggggcccggcatggatggccgcgactttgcgccgccgccgcatctgctgtcggagcgcgggagcctgggccaccgcagcgccgctgccgccgcgcgtctcgccccggctgggcccgccgcgcagccccccgcacacttccagccgggaaagtacttcccgtcgccgttgcccatggcttcgcacacagccagcagccgcctgatgggaagttctccggcctcctcgttcatgggcagtttcctcaccagcagcctgggctcggcagcctccacgcaccccagcggccccagctcctccccccctgagcaggcctaccgtggctcccaccccaccacctcccagatctggttctcccactcccacgaagctccggggtaccccagattttcggggagtctggcatccaccttcctacccgtgagccacttggatcaccatggaaacagcaacgttctctatgggcagcaccgtttctatggaacccaaaaagataacttctacctgcgcaacctgccgccccagcccacgctgctgccggccaaccacaacttccccagcgtggcccgggccgcccctgcccaccccatgggctcctgcagccgggatcgagaccggggtgaggcaggctccctgcagaagggccccaaggacttcgaccgcttcctcgtgggcaaagagctgggcagagagaaggcgggcaaggccgctgagggcaaggagcggccagcggcagaggaggacggtggcaaggagcggcacaagctggtgctgcccgtgccagccgacgggcactgcagggagggcggccccgcaccccgaggggcctgcgagggccgccccaagcacctcacctcctgcctcctcaacaccaaggtgctcaacggcgagatgggcagggctgcgctagccagctgtgcagggggcatgctggggcggcctggcacgggggtggtgacctccgggcgctgtgcaaaggaggcagcaggccccccggagcccgggccggccttcagcgagtgcctggagcggcggcagatgctacaccacaccgcatcctacgccgggccacccccgcccctcagcacagccgccggctccttcccctgcctgcagctgcacgggggccctgacgggctctgcccgctgcaggacaaagccccccgggacctaaaggccagcgggcccaccttcgtgccttctgtgggacacctggccgacaagggccgccccttccaggccgccgaggcctgtgccgtggcaggggagggcaaggaccggcacctggagggaaccatggcccccgaccacgctgcaccctatggagtctcctatgcccacctgaaggccgagggcaagggcgagcggcggcctgggggctttgaggcggccctcaacccccggctaaagggcctcgactatctcagcagcgcaggccccgaggcctccttccccggactccctaaaagcggtctggacaaaagcggctacttcgagttgcccacctcttcacaggactgtgcccggcctggtcaccaggacccgctgggcgggaaggccccccaggcctgctgcactttagataagactgttggcaaggaagccccggccggccccccaggggcacagaaggtggcccgcatcaggcaccagcagcacttgatggccgccgaggtggagcaggggggcattggggctgaggccaagcgcaagtccctggagctggcatccctgggctacagtgggccccacctgcccccatggggtgtccaggcaggccagggcaccgccatggccatcagcgaggagcgcaaggctggcgcctacctggacccctttggcagtggcctgcagcaggcggctcttctgccccaggaactgcctgcgccgccggacgaggtctcagccatgaagaacctgctcaaatacagcagccaggccctggtggtgggccagaaagcacccttggtgggcctgggtggcctcaaggccagctgcatccagcaggaagcaaagttcctgtcctctaagggcccaggccagtcggagaggccggactgtgcccgcagcagggagcacgacaccacgcacggcgacggggaggtgcggcagccccctgtgggcattgcagtggccttggcccggcagaaggacacagtgagccggtctgaggcagcctacggcaccaacactgcgcggcagggccgggccgcccccgccttcaaaggtggcggtgggccccgttccacacacgcgctggacctggaggctgaggaggagaggacgaggctatgtgatgaccgcctggggcttgccagccgcgagctgctgctgcaggacagcaaagaccgcgtagagttcgcccggatccacccaccgagcagctgccctggggacctggccccccacctcatgatgcagagcggccagctgggcggggacccagccccccacacccacccccatcccccctggctgccccgcacccgcagcccctccctgtggatgggggggcactcctacggcctggggcaccctgccctgcaccagaacctgccccccggcttccccgcctccgtggctggccctgtgccctctgtcttccccctcccacaggacgcccccacacagctggtcatcctgccctcagagcccacaccccacagcgccccccacgcacttgcggatgtcatggaccaggcgtcactgtggccccccatgtacgggggccggggccccgcctctcacatgcagcacccgggccagctccctgtgtactcgaggccgcagctcctccggcagcaggagctctatgctttgcagcagcagagggccgcccagttccagcggaagcccgaagaccagcacctggatctggaggagcccgcccaggagaaggccccaaagtccacccacaagccagttgccttaacccccacggccccgggcgccccctcacccgctgcaggccccaccaagctgccaccttgctgccatccgcccgacccaaagccccccgccagctcccccaccccaccacctcggcccagcgccccgtgcactttaaatgtctgccctgccagcagccccgggcctggctcccgggtgcgcagcgccgaggaaaagaatggggagggtcagcagtccacggccgacatcatcacatccgaaccagtggcacgtgctcactctgttgcccacgctggtctcgaattcctggcctcaaatgatccatccacctcagcctcccaaagttttgggattacagacctgcctcccggatacctgcgccccatggctggcctgggcttctccctaccctcagacgtgcactcttctaacctcgaggaccctgaaactatgcaaaccaccgccccgggggcccagcctgagcccacaaggacattcctgcctggggagccgcctccctgcagccccaggagcctggaggagcccgggctgctctcaggggccagggaggccacccaggaccttgccgccaccccctaccctaccgagcggggaccccaggggaaggcagcggaccccagcccactagaggggctacaagaactgcaatgtgcggccctcctggaggcagggggccccgaggccaccggccaggctcattctactcagggaggggcacgagaagagaggagcagggaggagggggagcaggggccctcgtcaggggcctcctcccaagtcctggagcagcgagcagggagtccgggtgcccttgaggacgagggggagcagccggcccctgaggaggacgagctggaggaagacgagctggggcagcagagcatggaggactcagaggaggactgtggcggagctcccgacaacagccacccacccagggcgctaccaggcctggatgccttggtggccgccaccatcaacctgggggacctgcccagcgacagcccaccggaccctcagcccccagcggcctctgggccccccagcacagtccccctgcctcatagctcagggattcatgggatcgctctgctcagcgagctggctgacctggcaatccagcggcagaggagtgagaggactgtgccagaggaggaagaggacgtgctagccttcaacctgcagcacctggccacgctggccacagcctggtccctggtggaggccgctggcctggacagctccactgccccagcgcagccgcccacagccaacccctgcagcggccccaggctcaccccccgcatgcagatcctgcagcgcaaggacacctggacccccaagaccaagcctgtgtgccccctgaaggccgccatcgaccggctggacacgcaggaggtggggatgcgcgtgcggctggcggagctgcagcggcgctacaaggagaagcagcgggagctggcccgcctgcagcgcaagcacgaccatgagagagacgagagttcacggagccctgcacggcgggggcctggccggccgaggaagcgcaaacactcaagctcgctgcctgccccacgtcccacggggccgctccccaggagcgatggcaagaaagtcaaggcggtgcggacaagcctgggtctgctgtgtgcggagctgcgaggaggcagtgggggcgagcctgcgaagaagcgaagcaagctggagaggagcgtctatgcgggcctgcagactgcctccgtggagaaggcgcagtgtaagaagagcagctgtcagggcgggctggcgccctccgtggcccacagggtggcccagctgaaacccaaggtcaagagcaaagggctgcccacaggcctcagctctttccagcagaaggaggctacccccggggggcgcatccgggagaagctgtcccgagccaagagtgccaaggtgtctggggccacacggcacccacagcccaagggccacggcagccgggagacacccaggtgcccagcccagccctccgtggctgcgtcccaggaggcaggcagtggctatgacagtgaggactgcgagggtctcctggggacagaggcaccacccagggaagcagggctgctgctgcacaccggggccagtgtggccgtgctggggccctcaccctcctctgtggtcaagatggaggccaaccagaaggccaagaagaagaaggagaggcaggggttgctaggggcctgccgcctgtccagccctgagagtgaggtcaagatcaagaggcggtcggtgaaggccaaggtgggcaccaccctggagcgggccccagggcagaggcccccaggtgcgctgggcaagaagaaagccaagggcaaggccaagggcagcctgcgggcagagccgggggccacccccagcagggacgccctcttcaacccctctcgggccttcgcctgccgtgaggagggcagccagctggccagtgagcgcctcaagagggccacgcgcaagggcacagtgctgcagccagtgctgcggcggaagaacggggccctgtccatcacgctggccacacgcaacgccaaggccatcctggggaagggccggaagctgagcaaggtgaagcacaaggccggcaagcagggcaagggccgggccgtgagccgcctgctggaaagcttcgccgtggaggaagactttgagttcgacgacaacagcagcttctcggaagaggaggaggacgaggaggaagaggaggaggacagcggccctctgagcgcagagcagagcgccgccctagcgcgctcgtgtgccatccacaaggaggacctgcgggacgggctgcccgtgctcatccccaaggaggatagcctgctgtacgcgggcagcgtcaggaccctgcagccacccgacatctatagcatcgtcatcgagggcgagaggggcaaccggcagaggatctactcactggagcagctgctgcaggaagcggttctcgatgtgcggccacagtccagccggtacctcccgcccggcacgcgggtctgcgcctactggagtcagaagtctcgatgtctgtacccgggcaacgtggtccggggggcctccggtgacgaagatgaggacctggactcagtagtggtggaatttgacgatggggatacaggccacatcgccgtctccaacgtcaggctgctgccccctgacttcaagatccagtgcacagagccctctccagccctgctagtgtctagcagctgccggaggaccaagaaggtatccagtgaggcacccccgcctagtgaagccgccacccccagcctgtcccccaaagcacaggacggccccgaagctttgaagacacctgggaaaaaatccattagcaaagacaaagctggtaaagccgaactcctaacctcaggtgccaaatcccccacgggggcctccgaccacttcctgggccgccgtggcagccccttgctgagctggtccgcggtggcgcagaccaagcggaaggcggtggcagcggccagcaaggggccgggggtgctgcagaacctcttccagctcaacggcagcagcaagaagctgcgggcccgcgaggccctgttccccgtgcacagcgtggccacacccatatttggcaacggcttccgcgccgactccttcagcagcctggccagctcctacgcgcccttcgtcggggggaccgggccgggcctccccaggggagcccacaagctgctgcgggctaagaaggccgagagggtggaggccgagaagggtgggcggcggcgggcgggcggtgagttcctggtcaagctggaccacgagggtgtgacctcccccaagaacaagacctgcaaggcgttgctcatgggggacaaggacttcagccccaagctcgggcggcccctgcccagccccagctatgtgcacccggcccttgtgggcaaggacaagaaggggcgggcacccatccccccgctgcccatggggctggcgctgcgcaagtacgcgggccaggcagagttcccgctgccctacgacagcgactgccacagctccttctcggacgaggacgaggacgggccggggctggcggccggcgtgccctcccgcttcctcgcccgcctgtccgtgtcctcttcctcctctggctcgtccacctcctcctcctcaggctccgtgtccacctccagcctctgctcctccgacaacgaggactcgtcctacagctcagacgacgaggacccggctctgctgctgcagacctgcctcacccaccccgtgcccaccctcctggcccagcccgaggccctgcgctccaagggcagcggccctcacgcgcatgcccagcgctgcttcctgtccagggccacggtggctggcaccggtgcgggctcaggccccagcagcagcagcaaatccaagctcaagcgcaaagaggccctgagcttctccaaagccaaagagctctcccggaggcagcggccgccctccgtggaaaaccggccaaagatctcagccttcctgcccgcccggcagctctggaagtggtcggggaatcccacacagcggcgtggcatgaaggggaaggcccggaagctgttctacaaggccatcgtgcggggcgaggagaccctgcgtgtcggggactgtgccgtcttcctgtcagctgggcggcccaacctcccctacatcggccgcatcgagagcatgtgggagtcgtggggcagcaacatggtggtcaaggtcaagtggttctaccaccctgaggagaccaagctgggcaagaggcagtgcgacggcaagaatgcgctgtaccagtcctgccacgaggatgagaacgacgtgcagaccatctcccacaagtgccaggtcgtggcgcgcgagcagtatgagcagatggcccggagccgcaagtgccaggaccggcaggacctctactacctggcgggcacctacgaccccaccaccgggcgcctggtgacggctgatggcgtgcccatcctatgctgagccgcccaccgcagatgcctcccacgtgcgccagggaccctgtgtgcggagcctggcgtcggccaagccaccgggcaggaggcagccccggcctcccaagggcgcatctgagcaaatatgcaaaagcccacagggcaagacccaggctttcttacggttttccctggaaagagcgctccaggtgtcggaatccagtcccgtcccatcctctgcggagggtcgggctgtggccctcatgggtccccggcccgccccacccacagcgccctccgtttcccgcaccggcagttcacgggagatttgaatccaagccatattccctagtacctccgactgtctcccaccagggaaagcagaaatcaggtgtgttgtctatttatttctctatgtaaatattgtatttctgcggggaaattttatggtaaaaagtggaaaagggtttttccccatccgcgtgacaaggtgtgtgtgagcgtgtatgtgtgtgcgcgtgtgtggcgatttttgtcctggggtttcctttggaaatgcactgttctcagcccagctgggttccaacgggggcacctgggacgacagaggcatctcggggcagggggcagaggccacgggagggtcaggtgggacccttgacggcaccctctgatctcttggggggacgaccgtgtaagatgaaagtcggtcaagtttatttgctttcagtgcatctcctagaaaagaagtgttggagcagggggtggtgatgaggggcccgtggggaaaggattcaagaggcaaagcccagaccagggagtgtgacaacagccgtgagcatctcacctgtgttcaaaacaagacaaagacgaacaaatattttaaagtattgataagaaaaagcaatgtttggattgtatctgctgaatcatattccaacctatatctgatttctgtttccggggccagttggtctgaggccaaggagtctggcctccacccagagcagggaggggctggcccctcgcccccctcaccctcgccgccctggcacactcgggaagcagggcccagctctgagcccctcctcacccctggggtcctaactttcctgaaagtagtaggtgccgtgagaaggggcagtttggccaggttcctgaactgggcagggctcggggcctatgagggcaggttcacagtcccaccagattctctcctcacccccaagcagaatgcatgcaaaagacaccccttttcccacccaccttattggtgcccccaaacccctggcctgctgcgtagatggtggtgaggccaggccagcagtgctgtggccaggggagaagaaaataaaacgcaggccctgcccttggggaaggcccctttctgggcccccttttccaccagccaaatctgcctggccctcggacccctctgcctgccccaacccctttggaggtttctcggccttttctgtgccacttggtggggcagatggcctgatgggctagtgcttggggcatagaatgagggtccccctgaccacctgagcccaaatcctggccccaggtgcaagcagcacccctcgagggctctgccccagtatccccagggaattcacacccctccccttctcccacagccaaggacagacaggctgcctggacctgagcccaacagccttcagcctcagaaacgcatggggggccacacactccttatatcctcccacactaaggttcccctggccccacgggagcttcaggaaagccccccaagttagccactgctctaggacgagctctgtgtcccccacaccacaggcctcgaagcagggtgctggtgggtgccctgtaccccaatcccaggtccccttggccccctatttttctcgggcccattggggcctgtttctcacctgctggctggaccccctgaagggccgttcccagaggctccccaggaggctcaaggctgggggcttatgttgtggtcgggggtccccgcctccagccccccgctcccacccccgagcctaccctttgtctcgcatgagtgcaatatttcattcccggtggttgtctggggaggtggttggacgaggtcctgcttgaggctcggggatcagaacgatgtcaagtgaagaaaaatgcacgggggcatgctgagccactggagttccagagagggccgaggagggtgcagccacggaggttggatcctctgctccgccgcctcgtcctcgtcccgcttctgctgggttccgctttgtccctggttttttcctttctttttctgtgtgcgtgcgaatggtgcggcccctcccctctcaccgtggttaacgtgacgaaggcacgattcctgtaaatgtgtaaactaaggggatggttggattttttttcaatgtaaacactaaaaacaaaatggacaaaaaaacacacaaaggttttatgaacagcagactctatgtaaaggcattttagtatcaaattttttattgataacttgcttaagaataaatatatggactattgtacaggt

SEQ ID NO: 192 - DNA, 1691 bp, Homo sapiens
gggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgctccggcagcggcccgaaacccagccccgccgctgacggcgcccgccgctccgggcagggcccatgccctgcgcgctccgggggtcgtaggctgccgccgagccggggctccggaagccggcgggggcgccgcggccgtgcggggcgtcaatggatcgccactccagctacatcttcatctggctgcagctggagctctgcgccatggccgtgctgctcaccaaaggtgaaattcgatgctactgtgatgctgcccactgtgtagccactggttatatgtgtaaatctgagctcagcgcctgcttctctagacttcttgatcctcagaactcaaattccccactcacccatggctgcctggactctcttgcaagcacgacagacatctgccaagccaaacaggcccgaaaccactctggcaccaccatacccacattggaatgctgtcatgaagacatgtgcaattacagagggctgcacgatgttctctctcctcccaggggtgaggcctcaggacaaggaaacaggtatcagcatgatggtagcagaaaccttatcaccaaggtgcaggagctgacttcttccaaagagttgtggttccgggcagcggtcattgccgtgcccattgctggagggctgattttagtgttgcttattatgttggccctgaggatgcttcgaagtgaaaataagaggctgcaggatcagcggcaacagatgctctcccgtttgcactacagctttcacggacaccattccaaaaaggggcaggttgcaaagttagacttggaatgcatggtgccggtcagtgggcacgagaactgctgtctgacctgtgataaaatgagacaagcagacctcagcaacgataagatcctctcgcttgttcactggggcatgtacagtgggcacgggaagctggaattcgtatgacggagtcttatctgaactacacttactgaacagcttgaaggccttttgagttctgctggacaggagcactttatctgaagacaaactcatttaatcatctttgagagacaaaatgacctctgcaaacagaatcttggatatttcttctgaaggattatttgcacagacttaaatacagttaaatgtgttatttgcttttaaaattataaaaagcaaagagaagactttgtacacactgtcaccagggttatttgcatccaagggagctggaattgagtacctaaataaacaaaaatgtgccctatgtaagcttctacatcttgatttattgtaaagatttaaaagaaatatatatattttgtctgaaatttaatagtgtctttcataaatttaactgggaaacgtgagacagtacatgttaattatacaaatggccatttgctgttaataatttgttctcaactctaggatgtggcttggtttttttttttctcttttcttttttaaacaagaccaagatcttgcttattc

SEQ ID NO: 193 - DNA, 1342 bp, Homo sapiens
gacaggggagcctctggggctgcagacactgcagacggacggacagacagatggacaacagctggaggcttggcccggccatagggctctctgcgggacagtcccagctgctagtgtcgctgttgctgctactgacccgtgtccagcctgggacagacgtggctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccatctcttgaccttgtgatccgcccgactcggcctcccaaaatgctgggattacaggcgtgagccatcaagtctggcgagagagattgtttctagatgagggtgggggcgggtgtccttagcccaaagcttgtgccagtctctatcggaaataaatgcccccaaaacctc

SEQ ID NO: 194 - DNA, 7817 bp, Homo sapiens
gcctgccggcctgagagcgggaccatggatgaaaggttcaacaagtggctgctgacgccggtgctcactctcctcttcgtggtcatcatgtaccagtacgtgtccccctcctgcaccagctcctgcaccaacttcggggagcagccccgcgcgggggaggccggcccgcccgccgtcccgggtcccgcccgccgggctcaggcgccgccggaggagtgggagcggcggccccagttgcccccgccgccccgggggccccccgagggacctcggggggccgcggcgccggaggaggaggacgaggagcccggagacccccgggagggggaggaagaggaggaggaagacgagccggaccccgaggccccggaaaacggctccctgccccgattcgtgccgcgcttcaacttcagcctgaaggacctgacccgcttcgtggatttcaacatcaaagggcgcgacgtgatcgtgttcctccacatccagaagacggggggcaccactttcggccggcacctggtgaagaacatccggctggagcagccttgtagctgcaaagcgggtcagaagaagtgcacctgccaccggcctggcaagaaggagacgtggctcttctcccgcttctccaccggctggagctgcgggctgcacgccgactggacggagctcaccaactgcgtgccggccatcatggagaagaaggactgtccccgcaaccacagccacaccaggaatttctattacatcacaatgttacgggatccagtgtcacgttacctgagcgagtggaaacatgtccagagaggggccacttggaaaacctctcttcatatgtgtgatggaagaagccccaccccagatgagctgcctacctgctaccctggggatgactggtctggggtcagcttgcgggagtttatggattgcacctacaacctggctaacaatcgccaggtgcgcatgctggctgacctcagcctggtgggctgctataacttgactttcatgaacgagagtgaaagaaacaccatcctgttgcagagtgcaaagaacaacctgaagaacatggccttctttgggctcactgagttccagaggaagacacagtttctctttgagagaacattcaacctcaagttcatctcccccttcacacagttcaacatcacgcgggcttctaacgtggagatcaacgagggtgcccgccaacgcattgaggatctaaacttcctggacatgcagctttacgagtatgcaaaagatctcttccagcagcgctaccaccacaccaagcagctagagcaccagagggaccgccagaagcggcgggaggagcggaggctgcagcgagagcacagggaccaccagtggcccaaagaagatggggctgcagaagggactgtcaccgaggactacaacagccaggtggtgagatggtgacctcctgccctctcctctctcaggagggggagggtgagcaggcacattgactttctgttgaggtaccttggagaagctgagccattctgaggacatctggctgtgtgtgcttgatttggacatcttcttccttctttgtcttcatttttatccagctggagattatccgtcttgttcttttttttcttgacattttgcaattggtgatattaagtagggtaggagtgcatcccatataggccattttagaaggccaaggagagccacaccgaaaaaggagacagttcctgtgatctcctttgcaggagcatagaatagtttgggtaccaggaacccacagaggcacacatgaaaagccaaattatggcttggatgttctgctgaaactggtctatgtcatactgtctcctgttatgagaatatcagttggtataaagagagagaaagagaaaaacatttcagcccttagatgaggtcttacaccaacccccacttggctgttggctgtcatcttgaactctatttgaatgtgacttaaatcacaagtaacgtgttttgttgttgcagttgttttgaaacaaaattatcctattattgaccattgctagagacccacatcctacaaaatcctgacaccataaccttaagccatgcctttccttccatcttttagggaacggggagtggatccaggacaggggaggttgtaacccctgagaaatgaacattggtaggagcatttaagagaaaacttgcttatttgctaatgcctaaaggggtctcactttaccaattgttactttcaatgtgaggaatgaatgataaattaagagaaaaaaatatcaggaaggtcaatatatgcctaacatttctaaactggccacataaccttagatttttaaaggaatatttcagagtttaatctttttggagaagttatgttctttaatcgggtactaccagtcttgaaattttgccaccacagaaagaaagatgtttttaaaagcttggcccaaagaataggaacttagctagcatgtatacaaaatatatttgaggttactaaatgaataaaaactcggaattaggccaggagacatggaataccattcatgggatggttatcacaggagtttagaaagactctgcctcccagcatcttgaatatctccagcctgttcactgttttcttcctacatgatctttacctgttgttagactgtggccacagccagtaaatcaggccagagtgtctcaaactggacaagaaatgtgctgcattgccgagttcttattttcaccttttcataatcccaactacaataacaagaattttattgactaataagggaatatgtatggaagaaggaagagaaagcctttgtctagcatttattaggaggatcagagtgagtgggaagtttcacaacggattgatctgatcaatcccttcaaggagctgaaggcaaaatgtgtaaaacccctaaatcagattgaaaagcctatttcattgatatccaacatgtttgatgtttaagctagctttacctaagccacttctcagcctccagaatactctctctggggttgtgagtcagtcagcccacaagcattcacagagtgcttacctgccccgagggaagtccagcagctccaccagatagagatctggagatgcttctctcactgtgcttggcttcatctggggtgcaagggaaggcattatcgggtggctcccttgctccaggaactgaacgaggcccttttcataccttaaatatattctgcacaacaaatgggtattgttagtctccatttcatagatgaaaatagtgaagcccacagaaaataagtagctcctccacaggttgtaagctaggtctagctgactgcaaaggtcaagttctctttactccgtcaccatatccatatggaataagggctcgtcctacctaaagcttcctgccaataatgcaagaagccagctgcaatttcccagaagcatttgtctctaacccatgtgggtagcccgaccatgacagcaccacgctaacagtgacccagagccatactgccttgggtcagtccagccccctccacatcactgagccatcaatgagctgagagatcaatgactttttaggcagctgtgttttttaagccatatacaagagtaagttaaaaggggccaagtaaatgttgcttgttatttggtagagattaggctcacaaaatatttctccatttccagtgatttgttcctaaggtagaagggaaggaggattgcagctgggattaatgttcgtctctctctctctctctctctagcttctcatctcattgttaggatctaatgttctgcctagaatagcaggactgcaaattatccttctgcctgcccctgtgacacacacacacacacacacacacacacacaaacaatccagtgttttgtcatgtggaaaatcaaaacaagttagaaagcattcagattgtttcttttaaactcactttaaaattttggcaaggaattcatgcataactgagacttggaggcagcccctgctcacttcacgctgttccttaggcacctcgggattggtatcaaaggcttccactgccttctgctgaaggcatgatgtatgcggctccacttgagaccaggtatcaggatgttcagagggagccagctctttatgttggccccaggccagtactaagcaaattaaaaagaccgacatgggcttcctccctcatatcatttcattctaaagcagcaagcttgtcatacccatggggtcctatgttgatagaaatggagaggtagggatacagtttattctccaaaaatggactgcccacttccatgctgagtgatgctcagggaagtgatgcccgcagaaggcgtctgggcctaaggatccatggaagtcaggagcattaaatcccaaaccaaatcaactccagatatatcagtgtcaaaagcccaagaaaagacaaaaaagaaaaaaacaatccccaggggttctatgaccctattgactcctacagttctttcccttctcttggcaatggaagctccagtacccagattggagattaggatgagacaactttgtgtatatgtgcacgtgtgtggtgtgtgtgtgttttattaaggactaagatacacacttatctattctgtctccttctagcttttaggcagcctactcttggaaactggaggaaactgccctgagaattattagaatgctaataatagtaattggtaacattaacaatcagtgttagacaacagtgaggcatatcatgtgtttttattaaaaatgataaagatgtgtttcttctcatctaaaggaggtaactttgtgataattagtttgattaaaagtttgaagtatgaggactccttgttatgcctttaaggtaatttttaaaaaaaatctgagtagagatagtactaatattggcaagaaggtccccaggatagacctagcaaggagataagaatagatcattaaaaaataaatataaatggattggatagaattcccattcagctgttttaacacagaaattcaaaatagtgacttaacatggaagctatttctctcttacttaaaggcaaactggttttacagctctggtgtgtgatgttaccagacgcctaggccctctcctgttgctctgtcatcctaatgtgctgcatccacctcatggaccaagatggctgccacagctcctgccatcacatttacatttaagatagtagagaggaagtggagggaagttgcacatattgcttccagtcacatctcatgggttaaaacctagacatttgccacatctagctgcaaagaaggctagggaatgtctttattattgattgtcatgtgccttgataagcataggaggttctgttattaaagaaacaatgtgaaataatgtggaaattaatactgataaagactatcagtatctgatacaaaagggaaccaaacgatatttaagtgctttttaatgtcacttacttcatcatatgttttgcgaaagataagactaaaattcatcactttgtgtagcatttaatggttttcagaacatttttgcatgtgctgtctcatttggtcctcattacattcttgtgtgctaaataggacctctattcattacaccacttgctagtttgggatggagagtcagatatgttgaaagatttcccaacgactctaatttatgagcaagaaagttgcttagagccccagccttttgacttcatagtctttccgactactttatgcagctcagcatcagtactgggattgggaactgcaagaatatgaaatgtaaatctttattgatttatatccttccttaccttttttgacatggaaaatgccaaagacactggtcaagtttactctcagctccctacctccagtgagggggcctcttattaggaatgaaatatccaagagatgggcggtgctgcaggggagaccaaaactcagaggaggcattcaaacacttctagcaggttgtctactccatccaactcaaaacctattcaatatgaaggccgagggaatgtgctcacaactccctattaagggaaatcaatataaacccgcccccaccaaccaaaaaaaaaaaaagaaagaaaactctccctttttaatgtcttcttccccaggctcctggtactttgtcagcaacatactgctttcattcttaaaggtttcattggctgttaaatgagtccctttgcatactcactggagagaggaaatgctttaagttgtcctaagataacatctgcacacagagagtttatctgattccttatcaaccatgatctctatctgaggtcctgtatagtgggatcatttagagatgggggttagggagagtaggagtaactctagagaaaattgtggctcctaaaggaggcagatctttccaaggtggaaaggtaatgaattaaatatatgacatgtaatactgaaaaaatagaaaaatgactaagatacagtctctgtcctctagaactagggcagcctggaaacatatggactataattattttagctatttaaaagaaatgaatgaagaggatcttgagacaggaccagagcattggaatggttgtagggactgaaagctgagttggaaggatcagatcaaagagaaagctgggttggacttacacaagaataccctgatctgatcgcagctgtgactccaaggttttcctttcccatagttgctgtgaccccattggtcaccagagcaactgcatgtcttcaggctgggtattagggctggctgggtctgatgattctacccattttgtgccatctgaggagcatgcgagggttctttctccaaggcactttcggccttccttcttctccccttccgccatctccactggacataagccaatgcctgctctcttctcaccacattcacctggacaaatctgaactaattccttgagacttcaaattagcccttctgagcaagtgggcaggttctgaaacctgtgtgttttgtagcctaatgaattgatggaatgcacatgaacccatcttcacagcatgtgaaagaaccaacctgcctggcagaggtgcagaaatttccagaggactggcctagctataaacaccagcaacatctgcaacacaaaagcccttgaacttctaggcaaggactcatgctaacctagcagtactccagattgagaacgcagatggacaggtgtctcttgagcctgtgttccaagatgtctgtggaaaggattgcaactgtcatcctttggcacactcagtggaacctgtgtgagctacatgttctgctgcattatgggaactcatcaaagggccagattgacatcttgccagaaaaaccagtgttttgaggagcaaaagttttgtgtacttcagtaattgtcacatgtgtcttccacctccttgacatttatttgttaatcatatgatcatttttttttcactttcctttttttctttctcagaagtacttctggggctttgattgcattatttctcttttaatgtatcatttcagtgttggaaagaaaaatctggatctttatgtggggacctattttacatgtagatagttattcagtagatagtaaattatttctcttaagagatatttccttttatttctgtacaataatatgtatgaactcagttactaggggactgtattgtgacattatcaacctttattgctatttaaaaatgatagtttgtagaactgaagatttccattgatgtgaagcacaatttaatgaataagttaaaatattaaactgttgtgatgtcaagagcaaaaaaaaaaaaaaa

SEQ ID NO: 195 - DNA, 746 bp, Homo sapiens
attctgctttccaactgcctgactgcttgttcgtctcactggtgtgagctccagcatcccctttgctcgaaatggaccccaactgctcttgcgccactggtggctcctgcacgtgcgccggctcctgcaagtgcaaagagtgcaaatgcacctcctgcaagaagagtgagtgcggggccatctccaggaatctggggctgtggctcaggttgggagggaactcaaggctggccctgagtgcatccttctggggaactgggctttctttgccctcattgcccgtgtcattccctctccaggctttctgccctaaattcagatggggcaggacagcatttttctcgtgggacacaaaccccaactgtaccccctatggtttcagaacagagctgtgccagacgaaaaaaagcatcctctgggtctgggttctgagctcgagccaggcttgctattagggcagggaggtgcccggtcaagtctactgccacctctcactctccccttcttccccaggctgctgttcctgctgccccgtgggctgtgccaagtgtgcccagggctgcgtctgcaaaggggcatcggagaagtgcagctgctgtgcctgatgtgggaacagctcttctcccagatgtaaatagaacaacctgcacaacctggatttttttaaaaatacaacactgagccatttgctgcatttctttttatactaaatatgtgactgacaataaaaacaattttgactttaa

SEQ ID NO: 196 - DNA, 2962 bp, Homo sapiens
agattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtagagggggagctgggcggatcagttaccatcaagtgcccacttcctgaaatgcatgtgaggatatatctgtgccgggagatggctggatctggaacatgtggtaccgtggtatccaccaccaacttcatcaaggcagaatacaagggccgagttactctgaagcaatacccacgcaagaatctgttcctagtggaggtaacacagctgacagaaagtgacagcggagtctatgcctgcggagcgggcatgaacacagaccggggaaagacccagaaagtcaccctgaatgtccacagtgaatacgagccatcatgggaagagcagccaatgcctgagactccaaaatggtttcatctgccctatttgttccagatgcctgcatatgccagttcttccaaattcgtaaccagagttaccacaccagctcaaaggggcaaggtccctccagttcaccactcctcccccaccacccaaatcacccaccgccctcgagtgtccagagcatcttcagtagcaggtgacaagccccgaaccttcctgccatccactacagcctcaaaaatctcagctctggaggggctgctcaagccccagacgcccagctacaaccaccacaccaggctgcacaggcagagagcactggactatggctcacagtctgggagggaaggccaaggatttcacatcctgatcccgaccatcctgggccttttcctgctggcacttctggggctggtggtgaaaagggccgttgaaaggaggaaagccctctccaggcgggcccgccgactggccgtgaggatgcgcgccctggagagctcccagaggccccgcgggtcgccgcgaccgcgctcccaaaacaacatctacagcgcctgcccgcggcgcgctcgtggagcggacgctgcaggcacaggggaggcccccgttcccggccccggagcgccgttgccccccgccccgctgcaggtgtctgaatctccctggctccatgccccatctctgaagaccagctgtgaatacgtgagcctctaccaccagcctgccgccatgatggaggacagtgattcagatgactacatcaatgttcctgcctgacaactccccagctatcccccaaccccaggctcggactgtggtgccaaggagtctcatctatctgctgatgtccaatacctgcttcatgtgttctcagagccctcatcacttcccatgccccatctcgactcccatccccatctatctgtgccctgagcatggctctgcccccaggtcgtcttgcacaccttggcagccccctgtagttgacaggtaagctgtaggcatgtagagcaattgtcccaatgccacttgcttcctttccaagccgtcgaacagactgtgggatttgcagagtgtttcttccatgtctttgaccacagggttgttgctgcccaggctctagatcacatggcatcaggctggggcagaggcatagctattgtctcgggcatccttcccagggttgggtcttacacaaatagaaggctcttgctctgagttatgtgacatgcctcagccccatggactaagcaggggtctggtataaaaacactcctggaaacgcctttgccctgatccaaatgttagcacttgctagtgaacgtctacttatctcaagttctatgctaaaggcaatttatcttgatgtgatgataaaccaaacttattagcaagatatgcatatatatccataaattctctttactctgtctccatcacttgatgcacataagtgccctgacctcagcatctcccctctaaaaaaaaaaaaaaaaaagtatctctttatctttcttccatagcctgacactgatatttgtgcacttaccttaactttggtctattttattcatccaaaaccattacatttcttggttttcacaaatgttccccatttcttagccagttccagacaatgtatagcaagcaggggaaggaaagcagtcaggagttcctgggtggccacggctctgcaatagcacttatgtcatggaagtgatatcccacctcctacatatactctttgcctaggtttttggaacaaggttatagtcagacactgtatctttagattgatgtcgaccacaaagttcagccagagcttgaggctagatgcacagccttgctattgggaagaaggccttttctagctgtacaacacagtctcactgggcattcatccagaaatagagaagaaagtctgccagacttgagttatgttgtcttttattagcagggaatgtcatcacagattggatagtacatccaggtgcaatgtcaccatcagcaaggtcagcttgacactcaagtggaagattagggaagaatgactaggataaaaaaaaaaggagggcaccaagggaaagggatgatggggtgagctggcgagtgtgggtgggaaatgaaatgtttattgaggatctgctttgtgctgggcactttaatccacattttatcgtttacttttcaaacagatgcaccttacccccaccccaatgctctgtccctgcagatatcagaagacagtgtgattttcatgctctgaagttcagttttacatccaagcatccctctctgttttttaacaatccaaagacaggccaaaaaaagcaccacagtttattaagtacttactaagcacccatccactgccccacactgtggcaaggattgtgaggggtaaagaagcatggggcacaatattctgctgccttcatgtaacttacagtctcacaaataaatagaacttcagttgaaa

SEQ ID NO: 197 - DNA, 649 bp, Homo sapiens
cggttccgggcgttaccatcgtccgtgcgcaccgcccggcgtccagatttggcaattcttcgctgaagtcatcatgagctttttccaactcctgatgaaaaggaaggaactcattcccttggtggtgttcatgactgtggcggcgggtggagcctcatctttcgctgtgtattctctttggaaaaccgatgtgatccttgatcgaaaaaaaaatccagaaccttgggaaactgtggaccctactgtacctcaaaagcttataacaatcaaccaacaatggaaacccattgaagagttgcaaaatgtccaaagggtgaccaaatgacgagccctcgcctctttcttctgaagagtactctataaatctagtggaaacatttctgcacaaactagattctggacaccagtgtgcggaaatgcttctgctacatttttagggtttgtctacattttttgggctctggataaggaattaaaggagtgcagcaataactgcactgtctaaaagtttgtgcttattttcttgtaaatttgaatattgcatattgaaatttttgtttatgatctatgaatgtttttcttaaaatttacaaagctttgtaaattagattttctttaataaaatgccatttgtgcaagatttctcaaa

SEQ ID NO: 198 - DNA, 8328 bp, Homo sapiens
aggatttccgcggttgtgtaacggcctgtcgcaggcgtgcagggacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctggcagagagactttcaagcagctggctggatgttcgtcatattgaaaagtatgtagaccaaggtaaaagtggaacaagagaattactttggtcctgggcacagaaaaacaagaccatcggtgaccttttacaggtcctccaggagatgggacatcgtcgagctattcatttaattacaaactatggagcagtgttgagtccttcagagaagagttatcaggaaggtggatttccaaatatattattcaaggaaacagccaatgtcaccgtggataatgttcttattcctgaacataatgaaaaaggaatactgcttaaatcttccatcagctttcaaaatatcatagaaggaactagaaatttccacaaagacttcctaattggagaaggagagatttttgaggtatacagagtggagattcaaaacctaacatatgctgtcaaattatttaaacaggagaaaaaaatgcagtgtaagaagcattggaagaggtttttatctgagcttgaagttttactactgtttcatcacccaaacatactagagttggctgcatattttacagagactgagaagttctgtctgatttatccatacatgagaaatggaacactttttgacagattgcagtgtgtaggtgacacggccccactcccttggcacattcgaatcggtatattaataggaatatccaaagccattcactacctgcacaacgttcaaccatgctcggtcatctgtggcagtatatcaagtgcaaacatccttttggatgatcagtttcaacccaaactaactgattttgccatggcacacttccggtcccacctagaacatcagagttgtaccataaatatgaccagcagcagcagtaaacatctgtggtacatgccagaagagtacatcagacaggggaaactttccattaaaacagatgtctacagctttggaattgtaataatggaagttctaacaggatgtagagtagtgttagatgatccaaaacatatccagctgcgggatctccttagagaattgatggagaagagaggcctggattcatgtctctcatttctagataagaaagtgcctccctgccctcggaatttctctgccaagctcttctgtttggcaggccggtgtgctgcaacgcgggcaaagttaagaccatcaatggatgaagttttaaatactcttgaaagtactcaagccagcttgtattttgctgaagatcctcccacatcactaaagtccttcaggtgtccttctcctctattcctggagaatgtaccaagtattccagtggaagatgatgaaagccagaataacaatttactaccttctgatgaaggcctgaggatagacagaatgactcagaaaactccttttgaatgcagccagtctgaggttatgtttctgagcttggacaaaaagccagagagcaagagaaatgaggaagcttgcaacatgcccagttcttcttgtgaagaaagttggttcccaaagtatatagttccatcccaggacttaaggccctataaggtaaatatagatccttcttcagaagctccagggcattcttgcaggagcaggccagtggagagcagctgttcctccaaattttcctgggatgaatatgaacagtacaaaaaagaataaattctaccagaagataaagaaaaaagcaagtattgcataggcacctgagcataggtatgaccttgggaagacattggctccataagcaatgccaagagaatgatcaatagtgagtttgggtgatgcagataaacaatctggataattccatttcttttttcccaaaccctcaaacagagtgccttaaaaaattgttttatcaggataattgtctcatgaccaaatccacgctcaattagagccattcaaaattccttaagatcatgggttctgacttcagccaaacaaaacaatcaaaacctaccaaaaagggactggattgtaatgtcctctccatcatcctcagtgtgagtcctcagagcctccatctgccaagaacattcagttggattccatcgtttggtttagcttgcttgcacgggttgtaggaaatgtctaatttgtaaatgttaatagatacctttggaaagaatcaccttgttattctgattgacccctcttgttttttggttaatccctgactagcctgcttgtctgaaaatgagccaggttcacccttagctacggcatgctctgggttgaaaggggatttcttcccaagatctatcctaaactcttaggacagtttatcctgtattgactattattacagctttttaaaaacagacttagtgacctattatatcttaaggagactatgtgaaatgtccatcaagtaatttttattcctgagaaaatggctggtcaagggcctaggtcagctttttgtttaatctacacctttcaactctgggccttcattcctgctgtttcttggatctccctcttttgaaatcctaccaatcatcagagctctacaaaacagccacctcctggaagcttccctaatctctacaaccagaagtactccctttatcagtatttccacagcaatttctttgtatttctattttatatttatcactttctgaattatatcaaagctgcttgtcttatctctttttttttttgagacggagtctcgctctgtcatccaggctggagtgcagtggcacaatctcggctcaccgcaaggtctgcctcccgggttcacgccattctcctgcctcagcctcccgagtaaaggtgggactacaggcgcccgccactacgcccggctaattttttgtatttttagtagagacggggtttcaccatgttaggcaggatggtctcgatctcctgacctcatgatccgcctgcctggcctcccaaagtgctgggattacaggcgtgagccaccgcgcccagccttcatctcttttactaggttgtaaactccctatattagttttctattgtttttgtaacacattatcacaaatttagtgacttaaagtaacataaattaattattttgcagttctggaggtcagaattccttagcattctttctggaggctgttggggagaactcactgccttgccttttccagcttctagaggccacctgccttctttggctcatggcctcttcctccgtcttcaaagccagcaacgtgacatttcagatctccctctctctgtctgtctcaccgcatctcttcactaccctcttcctctcattctggcccttctgcatgtcttttataaagacctttgtgatttcactgggcccactcatataagccaggaaaatctctgtgtctcagatccttaatttaattacacctgcaaagtccgttttctcgtgtaaagtaacatattcacaggtttctggaattgggacgtggacatcttcgggggaccattactctgtctgtcatactccctgagtgtgtaagggccatctcttcagagcctaatgtgtcatcctacacagagcaggtgtttccttataaattaagttgaattaaattacccctatgaagccacataatcaataattcagctataataaacattgccgaataaattaacaaagggaggataatgactccttatgatgatggatagaaacactgaagaaaaccattttcagaggatttactgaattttcctctccaaggagcttgtaatagaagggtaaacctctagtttcttgtccagcagaggaataggctcatgtcttttgttttattttatttttttggtgagtcagtatggttgggttaatcatattcacattagattccatgttgaagaacaactaatcaaagaagaaaatcatcaggaatcagggtgagattaacagaccaaggtcagaaacatggagttacaattttccaaaaaagcacgaagtgagattaaaaccacagtaagtcttagtctgactgacaggctttatacaggccctcggtaagcagttgggagaacccatgcccaccactgctctgtacggtatctggctgctcagagctctctgattcacaaaagagatcatcaagaattgactctgtgttaaactgtttttcacttagaatatggacccccaccaatacattcaatgaagggtcattaaggaagctctgattaacaccaggcccatgcagttactccgcacatataatctgtgggtattatgttgatttgaacttgcttagctgacttaaagcagggtttctcaaactgtagtatgcatcagaatgacttggaaagctggttaaaaacgcagattgctgggtccacccagcttctgatgcaataggtctggggttagaaattttgctttctaatgagttcccaggtgatgctgatgccaatgatgtgaagcccgctcttcacatccgtgaaaatcgctgccttaaggtgctcttaaattgttatagattggtagatcctacctttccatcactggtatgttttttgagaaaaggatcctttcttttcattctgttatattcatcctattacataggatgttggttagcacagagtgggagctctagaaagattgttgaccaatcatcttattgactagaccatctttctagagtataactattttggacacctcaaagatgaagtcagataagctggcagtgacctgattaacgttgtggtaagcagatgccactgtggctgggaagtaccaaatcttctgttgagtgattcagtcttcctgactagatttgccttctagtgggtgtattaataagcgttagttgatatgaattaaatgttgcaactttctatgggtaataagaggatacctttatagtttcatgatgtggagaccaagatacataagaaagcaagaatgagtctccgggtgttccctctgatcagcaaacatgaattcataatttcatttactctcatttttgtaatgcactctgagcaatcctccaggcagatcctatttactaagcttcaggcttttgtcccattttataatgcccaaacacatggagaaaacattttgttgtttttaaaaacaggtatgggatttctgatataatcaattttattgacttcttgggagttgtaatgatctgtgactcactgcataatattgtagttttatagggtggcacatcaccctgtgtaaaacaactttaatgacctgaggactgatgagtacaggaagtgaggtttatcatgagtagcatttattaagcatctgctagaatcaaagcactgcattagctactaaggtacaaagtaagacacagtttaataaggaagacagggcatctacccaagtcaacagttcagtgacatctgttatttgaaccacacaccaatgcaaccgaagtaaatgctgaaagggtgagaagaaggaatagattactatgcatttttgagaggatgaagaaggcttcttggagaaggtttctgaaaagagatacggaattaagagaaatagaaaagagcactgacgaagcactcaggatggctattcaaggaattggggatccacagcagctgtgcacaaccatccctaatgccagaaaaatggggtaagggtgaagggaactgggtctagagctttgcatgtttttttctggttaacccttagagtcaccctgaaggtgtggatcccatcttataataaggtgaggacactgagtcaggaaactaacttgctaaaatcaagtcctcccagtcctcccatcaggtccttccagatctggaggagccaggatttgaactcacatttgtctgacttcaaaatccatgctttttcttgtgttccaaattgcacaatggagtcactgccagttcaagctcctatgaaaagggatggatgtgaaaagtcatttgttgattccacagatttttagtaggtaccatgtctcctgcctttatcactatcctactcctctgctacaacttctctgctacaggcacccactgcagttacttgatatgagttaaatgaatccatccatccaaacttccattcattgaataaatacttagcaatggcttcctttgtatcaggcactattctaggagctggggctacagtgcagatggaaaccagcaaagctcactgccctcatggagcttatatgtaagtgaataaatctcagggtggttctcctgtcataggtcctggctcctctgccagctcttccaaatgggttcagagaggttttctccttgtcctgttgtgtaactgataatcccatggtggacctcactttgctattcatatgcactaagtagtttatggtgtgctttgtggctggcaattgtgacagattctattcttctattggtatgtggtttctttggggcatttgtttggatactgatggcatcttccgggggtctgaggcacctacacaaacctcaggtcactatcacgtgatactggagttgcctgttaaattatatttcttcttccacaaaactgcaggttccctgagggaaaggtctatgtcctgctcatttttggatccctaatggctggcacagtacctggtgcataatatggttcaacaaatatttgtaaaatgaatgaatcaaatagtccttcaaagcatcttcagaatcaagattgtcatctagattgcacccgaagtttatctttctagtattcagaatataatcaatcattgcttaaattattccatttcatcattcttgaataaaagctactaattttaaatactaatatctgagatatcttcgaaaagaagattagtcgttgtatgtgttgcttataaattttctctatggtggaaaatattcccaaaccatgtctaagcaatgaaaaaccagtgttctggcaggaaataaactgatgtttgttgtgttttgtatctgtcttcccgttccaaatcatttatatatacttgatggtctgtgggcttgacttgcaagtattttcctgggagacatttttattcaaaagacctgtattgcctgccaaaccttcatttaagagactcattatggatgtcatctgcatcattgcaaacttttctggtcgtctctataaatagcaagataatatttacagagttttacattggctcttgaattttaaaatattcttatagacaaacattaattggaatggggggtaaggaggtaggaatggcttacttgcggaaatgcaggctcattgttgtgtctagtaggtgctaggtgcattcacacatctcttaagctttaaacaacctattgagccggtttccatttccttgatctattagatttaaaaaaatgaagcataaaggagttggctcttgccctaagtcatactactgatggaatgagaatacaaaccaaaaacactttattcaagtccaggaaatatctgccttgaaaaagaataacttaaaaattaaaagtgtcctctatttgaacatgaaaacagctaataaagatgtgttattttattttattattattaattttgtcctcccatattggcaaagataaagcaattgacaaaaatggaattcttgttcaatactggcaggagtgaaaattggtagaacctttctagaaggcaatttggcaacatgtatgaaaacctaaatgttgatacacctttacccagcagtttgtttaggaatttatcctaatgaataaaagttgtccaagtcttcaaacatgagcccaaaggtatatttcatgatgtttatgatattaaaacattggaaacaactgaaacatccttcagtaaaagatggattaaataaattccatgcagttgtcatttaaaaatatttagatatatgtttattgctatggatatatgttcccaaaatattattgaatcaaaaagtagactacaggatatatgttgaatatgagctcatttataacattgaatattttaagataatgtatgtttcatagagagatcttcaccaaatgttaaggatttttttttctgggctgtggtatttgggtgatctttacattcttcagactcatgtgtgtttgaaactttttataatgaacatatatcatttttattagaaaagaataaagtttttgaaaaaaaaaa

SEQ ID NO: 199 - DNA, 3843 bp, Homo sapiens
ggaaacattgctctgcgagtcctcccgtttaaacgcattcaatttttgggtctctctctctctctctctctctcttcttctcttctctctctctctctctctcctctctctctctcctctttctcccccctctctccctcctctcctctctctctcctctcttctctgaacctctcttctctttctcttttcttacatattctactagttgttttccccttcttcttctcctttctctcctttttctccctcctccttgtctcttttactccattcctgcagaagagagagggctaaacttaaagaaaaaaaaaaggaggaggaggaggaggaggcacccccttcgtattcttcttatcgttattttatacatatatgattttttttggagggagggtgttggttgccggctgaagagcacttatttaaaatactaaaaaaagaacatttttgggcgatctccagggtttttttaactagctctgtgtgttatagcagaagaagcagaagaaggagcaagaaagaggaaaagaagaggattatttattcgacctactttggatgtctctctcgcttttcctttttcctttttttggcaattattttcttctgatttttattttttctatttcgctgtgatttcgtcgccggcgtgaattatcccgtatttttctcccccttccgtcacctcccgaaagaagaaggcagcgagagcccggcgccaccggcacaacaaaaagagcaaagtgtgtgatcttcctcgccggctgcctcccgctctccagcgctgccttcctgaatggctggctgcgtccggccctggacctggccccccgacacccgcgcgccctgatcgccggcggcagcctcgcccagcgccctgctcggctcaccgcgctccccgcactcccgagcccggcgagggctcccgccgggacagcggcggcgccgcgggcggccccggcctccgctcgcgctccggctgcggccccgactcctgctcggactccggcccgggtcccggctcctccagcggcgctcgccgcagcagctccggcggcagctccagcggcgcctgcagccgcgacctcctcctcctccgccgccgccgccgcctccgccctcgccggcttcctctatgtcggctcagcccgcgcgctgcgcgtagcccgagcggccggcgggcgggcgcccggcgcgggtgagcgactgtgtgtgcgagtgtgtgtgtgcgcgggggtgcgggcgaggcggagggcgagtgtgtgcgcgcgccgtggcccatgcccgccgcccccggcgctgcgccccgcgccgctcccggctgccgcctgtgccatttctgattttgcaacttggggaagaagaaaaaagcgagagaagggagcttgctcgccggggggtggggaggggggaaggagagcgcggcccccccaggaacggagcgcggggggagcgggcgaggggagcaggggtgttggggggggagcctgagagcctgggggggctgcaaaaagagagaaagaaaacagcaggaaccacaacaaaacgccagcagggcgggcgggcgcgcagcagcagcggggcggccgaggcagtagcggcggcagcggcggcggcggcggaggcagcggccggtgtccggctcgggctcggctcctgcgaccccggggcgcccggcgggccccccgccccctccccctccccccttccccttccccttcccctcccagcgcgcccgcgcgccccgcggccctcggcgagcagctcggctccccccagcgctccccgggcccaaagatatggcaatggtagttagcagctggcgagatccgcaggacgacgtggccgggggcaaccccggcggccccaaccccgcagcgcaggcggcccgcggcggcggcggcggcgccggcgagcagcagcagcaggcgggctcgggcgcgccgcacacgccgcagaccccgggccagcccggagcgcccgccacccccggcacggcgggggacaagggccagggcccgcccggttcgggccagagccagcagcacatcgagtgcgtggtgtgcggggacaagtcgagcggcaagcactacggccaattcacctgcgagggctgcaaaagtttcttcaagaggagcgtccgcaggaacttaacttacacatgccgtgccaacaggaactgtcccatcgaccagcaccaccgcaaccagtgccaatactgccgcctcaagaagtgcctcaaagtgggcatgaggcgggaagcggttcagcgaggaagaatgcctccaacccagcccaatccaggccagtacgcactcaccaacggggaccccctcaacggccactgctacctgtccggctacatctcgctgctgctgcgcgccgagccctaccccacgtcgcgctacggcagccagtgcatgcagcccaacaacattatgggcatcgagaacatctgcgagctggccgcgcgcctgctcttcagcgccgtcgagtgggcccgcaacatccccttcttcccggatctgcagatcaccgaccaggtgtccctgctacgcctcacctggagcgagctgttcgtgctcaacgcggcccagtgctctatgccgctgcacgtggcgccgttgctggccgccgccggcctgcatgcctcgcccatgtctgccgaccgcgtcgtggccttcatggaccacatccgcatcttccaggagcaggtggagaagctcaaggcgctacacgtcgactcagccgagtacagctgcctcaaagccatcgtgctgttcacgtcagacgcctgtggcctgtcggatgcggcccacatcgagagcctgcaggagaagtcgcagtgcgcactggaggagtacgtgaggagccagtaccccaaccagcccagccgttttggcaaactgctgctgcgactgccctcgctgcgcaccgtgtcctcctccgtcatcgagcagctcttcttcgtccgtttggtaggtaaaacccccatcgaaactctcatccgcgatatgttactgtctgggagcagcttcaactggccttacatgtccatccagtgctcctagaccttgggcgcttcccacctgccccgtccccctagagactcagaggacccacctgggccaaggactccaaagccgcggggacaccgggaagtgcagcgggccaggcaggctgggtgggagggaggagggccgagacaggagcagcccacccagcagaaatacaatccgagctacaaagcatgggaaaaagagactcttttaggatcagatctgtgagcacgttggcgaggaaaaacaaaacaaacaaaaaaaagaaccttgtgtctgtctggtgaaaaaaagaaaaacaaattggaagagaggaccatgagaattttaataaaacagaaggaaactaatggaccttccaggatttattgtggacggatgtggatatattctgtacaggaacaacacatatggaagtggactgaagcctatgtagaaacacacacacactgaacattgttattcattttgtaaaatactagtctttattttcattttttgtaaaatttaaacatcgtatgcgcataaagaaaaaggaaacaagaattaggggaaaataacattttccaaataattataaaaaattgtcctgtgtctatgtatctatatctgttttgtatttttttctggttccaaaccagatttcctgtgattctatactaataatttttgatataaccctttgcttcttataatgagtgcgatatatgttgtcgaggctgttcttcaagaattaaaattgaagtgaaaatttaaacaaaaataaaagaatttagcaaaa

SEQ ID NO: 200 - DNA, 6191 bp, Homo sapiens
agtccccagaaggagccagcatggacaatctcctttacagtttcggaagcaggtttgttgccatggagttcacattttgacgggagttgagaagtataaaggtaaccatttgttttagtttcaacgatctgacaaaaagataggctgttgctcttcttctggaaaagcctgattggtaagattcctttaagggctcagccccaaagagctttatcccatcccctcgcagactgaaaactaaagcctgcagagacctctgaaggaaaacctgtcccgggctctgtcacttcacacccatggctaaccctggaggtggtgctgtttgcaacgggaaacttcacaatcacaagaaacagagcaatggctcacaaagcagaaactgcacaaagaatggaatagtgaaggaagcccagcaaaatgggaagccacatttttatgataagctcattgttgaatcgtttgaggaagcaccccttcatgttatggttttcacttacatgggatatggaattggaaccctgtttggctatctcagagactttttaagaaactggggaatagaaaaatgcaacgcagctgtggaaagaaaagaacaaaaagattttgtgccactgtatcaagactttgaaaatttttatacaagaaacctttacatgcgaatcagagacaactggaaccggcccatctgcagtgccccagggcctctgtttgatttgatggagagggtatcagacgactataactggacgtttaggtttactggaagagtcatcaaagatgtcatcaacatgggctcctataacttccttggtcttgcagccaagtatgatgagtctatgaggacaataaaggatgttttagaggtgtatggcacaggcgtggccagcaccaggcatgaaatgggcaccttggataagcacaaggagttggaggaccttgtggctaagttcctgaatgtggaagcagctatggtctttgggatgggattcgcaactaactcaatgaatatcccagcattagttggaaagggatgcctcattttaagtgatgagttaaaccacacatcgcttgtgcttggggcccgactctcaggtgcaaccataagaatcttcaaacacaacaacacacaaagcctagagaagctcctgagagatgctgtcatctatggccagcctcgaacccgcagagcttggaaaaagattctcatcctggtggagggtgtctacagcatggaaggttccatcgtgcatctgccccagatcatagctctaaagaagaaatacaaggcttacctctacatagatgaagctcacagtattggggccgtgggcccaaccggccggggtgtcacggagttctttggactagaccctcatgaagttgatgtgctcatgggcacattcaccaaaagttttggagcttcaggaggttacatagctggaaggaaggacctcgtggattatttacgggttcactcgcatagtgctgtttatgcttcatccatgagcccaccgatagcagagcaaatcatcagatcactaaaacttatcatgggactggatgggaccactcaagggctgcagagagtacagcaacttgcgaaaaacacaagatacttcagacaaagactgcaggaaatgggattcattatctatggcaatgagaatgcttctgttgttcctctgcttctttatatgcctggtaaagtagcggcttttgcaaggcatatgctagagaaaaaaattggagtggtggtcgtgggatttccagccactcccctcgcagaagctcgggctcggttttgtgtttcagcggcacatacccgggagatgttagacacggttttagaagctcttgatgaaatgggtgatctcttgcaactgaaatattcccggcacaagaagtcagcacgtcctgagctctatgatgagacgagctttgaactcgaagattaagtttcctggtcctgaatgacacataaagactttgcgagaaagacctccctccttgcctcacaaggaatataaatggatttctcccccttcctcaggacaattttggttcccagaccagcttgattgaactgagggagacgttgttgtttttaatgtctccagcttggactgcagagacaaaaacatgattccagatttaagtctctcttcttccaagtattctactagaaatacacacacacacacacacacacttctgagaatatttttaatggcaataagcctgtgttttagctgctactgtgcagaccctttcagggattccaaccaaatgcaaatgagagaatttaaaatttttattcagtaagttcactatgtgtttacttattccatctgcagatgtaagtgagtgtggtggacagtagccaccttccttgttccactcataaaagcatcagctagatctcatctgtatcatgggaagttccaggcaggagggtaaagaaatgttgtttctaccatttgtcacatttggacgtttttcacagacaagtgtcaaaagacatagttaatgtttcgagggggaaagcagaactgatcaactgcgactagagacgtctttgaaggaaattttccttttcctcttgctggtctcctacagttttacagctgagcttttgaggtttggaaaattcaagatgtttgtttcataagaaaaggggcagaaagcaagcacaagacacttttaggtctagactaaaatggtagttacaacaatttgaaccttgttggtgcagtgcacggtgaatgcttaccctgcacagcctctattaccttaaggaattagttgtcattttcctattgaattttgagtaaatggtgaaattcagtgtcctttagaatcgactcccaagactatatttgaagaatgcattgattcaagaaggacatttaaaagcaaattctgactttttcaagaccaacacacttgtttaggcctattaaattgtactatcacttgttacatgccctctgaattgggagaaagtgggcttgcacactttgaggtaactaactgtaatttacttgtgttctctctttcttgctctccttctcaacatgaacacaaacctctatggaaaagtagcctcttgttaatctgatctagtttgtatggaaaaagcccatggagaaccttatctttaacaagctcccagagggtgcccagatttggaaattctagagagcagtggtgaccttttagcaaagcttctgtaacagttcgaatgagttgcagaacattccactccatcaaatgacactgtaaacaaatcacttcaagagaggcttggttttgtgtggcacagatggacccaagctttcatgctgtgcactgagatagaaactccacccgcagcgcctgcgatggatggagcagtgtgccctgatgctcaaagcgtattaaaggaaaaaaagtgatcagcatggaaagtttttatggggaaattataactccaagtgggtgcattggtttaaaaatggatcacaatgatagagttcttcatgaatgtttacaagttgtaaggaataccgttagtgaaagaggaaaagaagtgggttctgaaaatgcagtttcccatccaatgattttgataacaaaattccaacttttctcaatgaaactgatgcagtattatttgtgcaaataaaatgtgtcataaatatgcaaagaaagggagacatactgttcttatcttgaatatgtgcatttaaatgaattgtccaaaatgcataaatgccttgcgttctataaaggaaacaggaggtcaaaaagacagcgagatatctagtccttccacaaggtatggaaagcaataaacatcttcctttctttctggatctgtctgtgatgtttacacacaccttcacatctacacttcaagttttaagcccctagacatgtgtcttcatgagcaggaatgtccactattattactttcatggaggatattgggtctaattcattgtgggaaactacttacctacccagcatggaaggcagggaggaagttagtctcttttcatcaagattcaagagtacaggggcaatttattacactgcaatgtacaaaacaaaaggacctgtttctgttagagagtccatgttgaatatacaggtatgagaacaactgttgatatacaggtataatccaagtagaatgcttccacagtgcattagaaggtgcccaagctccacagggccaataatattagagtatatgtcatatagaataaggttaattaggagggtgattgtgaataatgagatttttaatttttttaagaaaaagctctcaaatgctaggctaataagttcatgattttaattcatgattttaattcatgattaaaattatttgattattgagtcttgataattatatcatcaaccattaccctctacatcaccgccccgaccttagctctaattatatcagagccaaaaatgtgtctttggttagatctgttggaaaagagaattttctataatgttatgcgcactcagcccttctgttcacatttacacacatgcacacacacatacacatatgcatttttcctttacggagtaagcaactatgaaaatctggttggttgagaaataaatggaagatgttcttgaaaatgacctcaggaaagcagaagataaaggttccagatgatatttgtaaggaggctatctctgtataataaggaaatggcatagacttattcctaatctcattatgaaacgatggtgtcatggacgtttaaccatattgcctttcagcatgctttgattttacagagacgacaggctttggaatttactaggaagctggctaaaatccatacccctaggccctacaccagacctttactgaaacataatagttgtagtgcccaggaatctacatttttaaccagccttcctgcgtgattctaatctatgccaaaatttaagaacattattcaaactctaatttgataaaccaattgactctaatagcaggaaccttgttctgattctcttgttcataattaagtgtatatatactggtaaaattaatttattccacagtcaaccttctcttctcattgggacattttgttcccattttccaagtaacttctctttctacaaaaattgatccaatattgaagaaccatctgcgattcatttgggtaaaattatgccttcttcagttttctgtatcattccctataagatgcccatttgctttgaatgtggtatctttcttttctttctttctttttttttttttttttgagacagagttttgttcttcttgttgcccaggctatagtgcaatggcaagatctcggctcattgcaacctccacctcccgggttcaagcgattctcctgcctcagcctcctgaggagctgagtttacaggcatgtgccaccaagcatggctaattttctatttttagtagagacaaggtttttccctgttggtcaggctggtctcgaactcctgaccttaggtgatcctcccacctcggcctcccaaagtgctgggattacaggcgtgagccaccgtgcccggcctgaatgtagtatctttcttctgttttcttttcctgctctttaaaaaacaaccttcaacctctgattatttattccaacaacagctcttcagtagggtaaaagtcttaacagttcttcaaacgaacaatattcttttgtatttttcttcagagatagcaaatgttataaatggcctactctgatttaaaaacctaagttccgatgatgatgaaacattaactcttaaatatacattttgatttatagcaataataacaattgtaacaacagcaattaagaacagcatctggtgaattcttggcaatgtttcctggtctcaaaacagtaagaacaatttgaagtctgttctttagaatgccctactcagctgcataatgtttagaaaattaaagagtctgtattttaaatatttttaggtaattattgcgggacattgtcttatggtgtcctgatgtacgtggggtgtgcatgtgtgtgtgtgtgtgtgtgcatgtgtctttgtgtgtgtgagaaggacagagagaaatgtatgtttcactgaaacatttgaaacgaccaatttcactttattgtgcctgtaaaatgttagttttaaaataaataaaaataatatgaaaataa

SEQ ID NO: 201 - DNA, 1943 bp, Homo sapiens
agtgcgctgtgctcgaggggtgccggccaggcctgagcgagcgagctagccagcaggcatcgagggggcgcggctgccgtccggacgagacaggcgaacccgacgcagaagagtccaccaccggacagccaggtagccgccgcgtccctcgcacacgcagagtcgggcggcgcggggtctcccttgcgcccggcctccgccctctcctcctctcctttccccttcttctcgctgtcctctcctctctcgctgcccgcgtttgcgcagccccgggccatgtccgacgcgtccctccgcagcacatccacgatggagcgtcttgtcgcccgtgggaccttcccagtactagtgcgcaccagcgcctgccgcagcctcttcgggccggtggaccacgaggagctgagccgcgagctgcaggcccgcctggccgagctgaacgccgaggaccagaaccgctgggattacgacttccagcaggacatgccgctgcggggccctggacgcctgcagtggaccgaagtggacagcgactcggtgcccgcgttctaccgcgagacggtgcaggtggggcgctgccgcctgctgctggcgccgcggcccgtcgcggtcgcggtggctgtcagcccgcccctcgagccggccgctgagtccctcgacggcctcgaggaggcgccggagcagctgcctagtgtcccggtcccggccccggcgtccaccccgcccccagtcccggtcctggctccagccccggccccggctccggctccggtcgcggctccggtcgcggctccggtcgcggtcgcggtcctggccccggccccggccccggctccggctccggctccggccccggctccagtcgcggccccggccccagccccggccccggccccggccccggcccccgccccggccccggccccggacgcggcgcctcaagagagcgccgagcagggcgcgaaccaggggcagcgcggccaggagcctctcgctgaccagctgcactcggggatttcgggacgtcccgcggccggcaccgcggccgccagcgccaacggcgcggcgatcaagaagctgtccgggcctctgatctccgatttcttcgccaagcgcaagagatcagcgcctgagaagtcgtcgggcgatgtccccgcgccgtgtccctctccaagcgccgcccctggcgtgggctcggtggagcagaccccgcgcaagaggctgcggtgagccaatttagagcccaaagagccccgagggaacctgccggggcagcggacgttggaagggcgctgggcctcggctgggaccgttcatgtagcagcaaccggcggcggctgccgcagagcagcgttcggttttgtttttaaattttgaaaactgtgcaatgtattaataacgtctttttatatctaaatgtattctgcacgagaaggtacactggtcccaaggtgtaaagctttaagagtcatttatataaaatgtttaatctctgctgaaactcagtgcaaaaaaaagaaaaaagaaaaaaaaaaggaaaaaataaaaaaaccatgtatatttgtacaaaaagtttttaaagttatactaacttatattttctatttatgtccaggcgtggaccgctctgccacgcactagctcggttattggttatgccaaaggcactctccatctcccacatctggttattgacaagtgtaactttattttcatcgcggactctggggaagggggtcactcacaagctgtagctgccatacatgcccatctagcttgcagtctcttcgcgctttcgctgtctctcttattatgactgtgtttatctgaaacttgaagacaagtctgttaaaatggttcctgagccgtctgtaccactgccccggcccctcgtccgccgggttctaaataaagaggccgaaaaatgctgcaaaaaaaaaaaaaaa

SEQ ID NO: 202 - DNA, 1636 bp, Homo sapiens
acccgagcaccttctcttcactcagccaactgctcgctcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctgcgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcataa

SEQ ID NO: 203 - DNA, 11501 bp, Homo sapiens
gtcctcccctgcgctgagccccgcagccagcgcagccttcccgggaagcgcggcggccgctcccgagcgcagccctgcccggcccgccagccgcgcgtcccggcgcccgcgccccacggccacagccttgcctctatctagctcacggagcatgtgcagacccgcaggcgctaaggtgctctcagtccgggggccttctgggcagcggtgactgtcaccccaagagagacctttcgggggctcttgccgcacctctgctgcgtcgcgggtgacactgcggtgctcgcgagcagggtggcagctgcctctcggtggagacgtcttgggacccttgcgcccttcttctctccttccttcgctgctgtctcctttccttccttggctgctcgctctttctctcgccggctcagacccgtagcctccggaacgggactcgtgggtcgccgccgcctctgtctcttccaaaggggcctcctcacttcggagatgcagtgacaagttaatatgggcgtccaagcctctgtttcccaggaggaaatttgcaagaggcggcagcccctgagcgcccagagctcttgaaaggccacccaggagaggtgtgagacccggcggcagcatccgtccaggtgggacccgctgagcgccgtggccagtcccccattcccatcccggcaccccaaaggcgcgctcgcccgattgcttcgagttccccgacctggggattttttttttagccgctggtggtgggcgcctcgtgggctaaggcccggcgcctgctctgctacccgcgctgcctttagcggtcgcccccgccgccgctgccagggacgtgctgggaaagcccaagccccgggagaagatgccggccatcctggtcgcctccaaaatgaagtcgggactgcccaaacccgtgcacagcgccgcgcccatcctgcacgtgcccccggcccgggcgggcccccagccctgctacctgaagttgggaagcaaggtggaggtgagcaagaccacctatcctagccagatccccctgaaatcgcaggtgctgcaggggctgcaggagccagcgggggaggggctcccgctgcggaagagcggctcggtggaaaacgggttcgatacccagatctacacagactgggccaatcattacctagccaaatccggccacaagcgtctcatcagggatctccagcaagatgtgacagatggcgtcctcctggcccagattatccaggttgtggcaaatgaaaagattgaagacatcaatggctgtccgaagaacagatcccaaatgattgaaaacatagatgcctgcttgaatttcctggcagctaagggaataaacatccaggggctgtctgcagaagagatcaggaatggaaacctcaaggccattctaggcctcttcttcagcctctcccgatacaagcagcagcagcagcagccccagaagcagcacctctcctcacctctgccgcccgccgtatcccaggtggccggggccccctcccagtgccaggctggcacccctcagcagcaggtgccagtcactccccaagccccgtgccagcctcaccagccagcgccacatcagcagtcaaaagcacaagctgaaatgcagtccagacttccaggtcctaccgcgagggtatccgctgcaggcagcgaggccaaaacacgcggagggtcaactactgctaacaaccgacgcagccagagctttaacaactatgataaatccaaaccagtcacctccccacccccaccgccaagcagccacgagaaagagcctttggcaagttcagcctcctcccaccccggaatgagtgacaatgcacctgcttccttggagagcggcagcagctccacccctactaattgcagtacctcctcggccatcccgcagcccggtgcagccaccaagccttggcgcagcaaatccctcagcgtgaagcacagtgccacggtatccatgctctcggtcaagcctcctgggcctgaggcccccaggcccacacctgaagccatgaagccggcccccaacaatcagaagtccatgctggaaaagctgaaacttttcaacagtaaagggggctcaaaggcaggtgaggggccggggtcccgggacacaagctgtgagcggctggagactctgcccagcttcgaagagagcgaggagctggaggccgccagtcgcatgctcaccaccgtgggccctgcttccagcagccccaagattgcactcaagggcattgcccagaggacttttagccgggcactgaccaacaagaagagttctctgaaaggcaatgagaaagagaaggagaaacaacagcgggagaaggataaggagaaaagcaaggaccttgccaagagagcctctgtgacggagaggctggacctcaaggaggagccaaaagaagaccccagtggagcagctgtgcccgagatgccaaaaaagtcctccaagattgccagcttcatccccaaaggggggaagctcaacagtgccaagaaggagcccatggccccttcccacagtggaataccaaaaccaggaatgaaaagcatgcccgggaaatccccaagtgccccagcgccttccaaggaaggggagcggagccggagtgggaagctgagctcaggactcccccagcagaagccccagctggacggcagacactccagttcctcttccagcctggcgtcctcagaaggaaaaggcccaggagggaccaccctgaaccacagcatcagcagccagactgtcagtgggtctgtcgggaccacccagaccacaggaagcaataccgtcagtgttcagctacctcagccccagcagcaatacaaccatcccaacactgccacggttgcacctttcctgtacaggtctcagacggacactgaagggaatgttactgccgagtcaagctcaacaggtgtgagcgtggagcccagccacttcaccaagactggacagcctgctctggaagaactcactggggaagatcctgaggctcggcggctgcggacagtgaagaacatcgctgatctgcggcagaatttggaggaaaccatgtccagtttaaggggaactcaggttacacacagcacattggaaaccacgtttgacaccaatgtcaccacggagatgagtggccgtagcatactcagcttgacagggaggcccacacctctgtcctggagactgggccagtccagccctcggctccaagcaggagacgccccctcaatgggcaatgggtatccccctcgagccaacgccagcaggttcatcaacactgagtcaggtcgctatgtgtactccgcccctctgagaaggcagctggcctcccggggcagtagtgtctgccatgtggacgtctcagacaaggcaggagatgagatggacctggaaggcatcagcatggatgcccccggctacatgagcgacggggatgttctgagcaagaacatccggaccgatgacattacaagcggatacatgactgatggtggacttggcctctatacccgtcgcctgaaccggctccctgatgggatggctgtggtacgggagaccctgcaacgaaatacctccctgggcctcggagacgctgacagctgggacgacagcagctccgtcagcagcggcatcagcgacaccatagacaacctcagcactgatgacatcaacaccagctcctccatcagctcttatgccaacacacctgcctcctctcgaaaaaacctggatgtgcagactgatgctgagaagcactcacaggtggagaggaattccctgtggtctggtgatgatgtcaagaaatcagacggaggctcagacagcggcataaaaatggagccaggttccaagtggaggcggaatccttctgatgtgtctgacgagtccgacaaaagcacgtcgggcaagaagaatcctgtcatctcccagacaggctcatggcggcgaggcatgacagctcaggtgggcatcaccatgccaaggacgaagccttcagccccggcaggcgcactgaagaccccaggaactggaaaaacagacgacgcaaaggtgtctgagaaaggaaggctttctcctaaagcctcccaggtgaagcgctccccatcagatgcaggccggagcagtggtgacgaatccaaaaagcccctccccagcagctctaggacacctactgccaatgccaacagctttgggttcaagaagcagagtggttccgccgccggcctggccatgatcacagccagcggggtgactgtcaccagcaggtcagccacactgggcaaaatcccaaagtcatctgcactcgtcagtcggtctgctggtcggaagtcaagtatggatggggctcagaatcaggatgacgggtatctagccctaagctcccggacaaaccttcagtaccggagtttgccgaggcccagtaagtccaacagccggaacggggctgggaacaggtctagcaccagcagcatagattccaacattagcagcaagtccgcaggcctgccagtgcccaaactgagggagccttccaaaacagccctaggcagctctctaccaggtctggtcaaccaaacagacaaggagaaaggcatctcatcagacaacgagagtgtggcttcctgtaactcggtgaaagtgaatccggcagcccagcctgtgtccagtccggctcagaccagtctccagcctggagccaagtacccagatgtggcctctcccacactccgcagactctttggtgggaagcctaccaagcaagtgcccatcgccacagctgaaaacatgaaaaattcggtggtcatctccaatcctcatgccaccatgactcagcaaggtaacctagactccccgtcaggcagtggcgtcctgagcagtgggagcagcagtcctctctacagcaagaatgtggacctcaaccagtctccgctagcctccagccccagctcagcccactcggccccttccaacagcctcacctggggcaccaacgccagcagctcctccgcagttagcaaggatggcctgggctttcagtctgtcagcagcctccacaccagctgtgagtccatcgacatctccctcagcagtggaggggtccccagccacaattcttccactggcctcatcgcctcctccaaggacgactccttgactccctttgtcagaactaacagtgtgaagaccacactgtcagaaagccctctctcttcccctgctgctagccctaagttctgcagaagtactctgcccaggaaacaggacagtgacccgcaccttgataggaacactttgcctaagaaaggactcaggtatactcccacctcccagcttcgcacgcaagaagatgcaaaagaatggttacggtcccattctgcaggaggccttcaggacaccgctgccaattcccccttttcctctggctccagcgtgacttctccctccggaacaagattcaacttttcccagcttgcgagtcccaccactgtcacccagatgagcttgtccaacccgaccatgctgaggactcacagcctctccaatgctgatgggcagtatgatccatacactgacagccgcttccggaatagctccatgtccctggatgagaagagcagaaccatgagccgttcaggctcattccgggatgggtttgaagaagttcatggatcctcactctccttggtttccagcacatcgtcagtttattctacaccagaagaaaaatgccagtcagagattcgcaagctgcggcgggaactggatgcctcccaggagaaagtttcagctttgaccacccagctgacagcaaatgctcaccttgtggcagcctttgaacagagtcttggtaacatgacaatcaggctccagagtctgaccatgacagctgagcagaaggactcagaactgaatgagttaagaaaaaccattgagctgctaaagaaacagaacgcagctgcccaggctgccattaatggagtaattaacacacctgagctcaactgcaaaggaaacggcactgcccagtctgcagacctccgcatccgcaggcagcactcctcagacagcgtctccagcatcaacagtgccaccagccactccagcgtgggcagcaacatagagagtgactcaaagaagaagaagcggaagaactgggtcaatgagttacgcagctccttcaagcaagctttcgggaagaagaagtccccaaaatctgcgtcctctcattcagatattgaggagatgacggattcttctttgccttcctcaccaaagttaccgcacaatgggtccacaggttccaccccactgctgaggaattctcactccaactctctaatttcagaatgcatggatagtgaagctgagaccgtcatgcagctccgaaatgagttaagagacaaggagatgaagctgacggatatccgcttagaagctctcagttctgcccaccagctggaccagctccgggaggccatgaacaggatgcagagtgaaatagagaagctgaaagctgagaatgatcggctgaagtcagagtctcaaggcagtggctgcagccgggctccttcccaagtgtccatctctgcctccccgaggcagtccatgggcctctcccagcacagcttgaacctcactgagtcaaccagcctggacatgttgctggatgacactggtgaatgctcggctcggaaggaaggaggcaggcatgttaagatagttgtcagctttcaggaggaaatgaagtggaaggaggattccagaccacatctctttcttattggctgcattggagttagtggcaagacgaagtgggatgtgctcgatggggtggttagacggctgttcaaagaatacatcattcatgtcgacccagtgagtcagctagggctgaattcagacagcgttcttggctacagcattggagaaatcaagcgcagcaacacttccgaaacaccggagctgcttccttgtggctatctggttggagagaacacgaccatctcagtgactgtgaaagggctcgcagaaaacagcctggactcactggtgtttgagtccttgattcccaagcccatcctgcagcgctacgtctccctcctgatagagcaccgtcggatcattctctctggccccagcggcactgggaaaacctacctggccaaccggctgtctgagtatatagtgcttcgagagggacgggagttgacagacggggttatcgccacctttaacgtggaccataagtccagcaaggaattgcgccagtacctgtccaaccttgctgaccagtgcaacagtgagaacaatgctgtggacatgcccctcgtcatcatcctggacaacctacaccacgtgagctctctgggagagatcttcaatgggctgctcaactgcaagtaccacaaatgcccttacataattggcacaatgaaccaggctacctcttcgactcccaacctgcagcttcaccataacttcagatgggtgctttgtgccaaccacacggagcctgtgaagggtttccttggccgattcctgaggaggaagctcatggaaacagagatcagtgggcgggtgcgcaatatggagctggtaaaaatcattgactggattcccaaggtctggcatcacctcaaccgcttcctggaggctcacagttcctcggacgtcaccatcggcccccggctcttcctgtcatgccccatcgatgtggacggctcgagagtgtggttcaccgacttgtggaactattccattatcccctatctcctggaagccgtcagagaaggactccagctctatggaaggcgcgccccctgggaggatcctgccaagtgggtgatggacacatatccatgggcagccagcccacaacagcacgagtggcctcccctgctgcagttacggcctgaggatgtcggcttcgacggctactccatgcctcgggagggatcgacaagcaagcagatgccccccagtgatgctgaaggtgacccgctgatgaacatgctgatgaggctgcaggaggcagccaactactccagcccccagagctatgacagcgactccaacagcaacagccatcacgatgacatcttggactcctctttggagtccactctgtgacaggggcccggagcccagcgccctcctcttctcctcaccgcattccacctgcatcccccacatcaccctgaagatgacttcctgagccagcccccagccacagccttagagctgcgggaacaccgagaccccccgtccttcagcctcgacctgggtgcaggcatcccgggccagctgcctgcggaccgcttccttccacagcgagaactgcactaccttctgttgtactttaattattgttttgccttgttgctgtgacctccctaagacactgaagatacttctcgggaaaggatcatcgccgttgaaatgaaaagagagacagagagaaaaaaaaaaagagaacccacatgaagctctgaaaccaaacagcatcctgccatgagcttcccagagacagaagagactggagcaaagtcggaaacacagagaagcacggcttcccctcagcacagaccctccagactgggtctcagagccgtgccacccaccctcccacacagccggccacagggagaactggtgctaaccagggtgcttgctttggtcacgttcaacgcactacagagctacgacacagggaaaccttaggagcaaataaaccgtgctttcatgttttttaaatggtgctttccttacccgagaggtattttgcctgttccaatcaaaccaccccattcaggtccatcagcctctgattaatatccgtgagagtgagtgacggagtgagagtgtgagcgagtggatgtggctgtcagtgcagaacagcatgtgtctctttccttctgatatatgaatgaatcaggtttttttttttttttttctgcaaacactgtgtatagtgagacttgttctactttggagaacaggttaccttttgaaaatgaggttgagtttcttcctttctgatgcattgatttttgaagatttttttttcccccttcccctcttggtcagaatcaatcctttggtgaaagtaagaaccgcaggagttgagttttggtttggtcctgctcagttttggtttttagttgtccatcctcacagtcctacacactcgcctcctcctgctagggctgggggtatctgtgtcctttaaaatggatgaggacctggtcctcgacatgtgggtgagccatggaccttgccttcccttctcgtccttgagggtttagaacacacaccaacacctccagcgtccccgccccagcttccggtggggtgatgcggtcaccctgcaaaagacttgcactttcctcagaaccaacatgacgcagctcaataagggtgagggtcactccctcccagaagccccgtctggacgagccttgcctgacctcttcggtgctgaccttcccaaagtgatgccttactggttttgtactaactgtgttcattttacataagtgtcgtgcctgcctggggtttgttttttttgtcattgttttccccattgaaacaaacagggctaaaaagtcatctgttcattaggagaactcaagttgctgtgacttttctcatccaaaagactcatttgtgtggatgcgtgaccatgggaaaaagaaaaaaaaaaagatccattttttaggttcttttcggtctccagctgacaacccaactggacaatgatctgtctggtgcaggagaaggcaaaagtttctacaagtctacatgaccttgctgatacttgttctaatagaaacccagtctgctgtgtcttcaacatactggtattttcattacaaagtatggtaaatttttgagttgtttgtttctgttttgtaaagagaatccttattggacaccagtgaaggtgtctctgttttaatgatcagggtttttattccatcttttgcatttcttctatttctgaaggtttgtctcttggcatctttttttagtttcttaccataagagtttgacccgaaactgctcacttcacattggatgacaccatgttcttcctctttgaaaagaaaaggggaatgtgtcccactagtgaaaggaaaacttttcaacactatccctgctttagtctcagcaaactcagactattctgcttagccttcattagtcatctgggtgtgagtgtgtcttgttctgtttttctttttaataaaacttttaaaccatatatttagcctgtgaccaggggggccaaaccctaagatttctggtaaacctgaagggtggccctcctcagacaatttatctcccagcaatgaccctactacactcgcgtactgtgaatttgggaggaggtaaagttgacttctcctcgtgggcagttttccaatcaccttgtgagtagacacctgccaatattgtttgaaacctttttttaatatgacatcctctcttgtcattctcttctcccctttcccacagacttccctcctgggtccaggttcagaaccaagacttctgtacctagtgctgcctgattggtgaacattgacttcaagtagcatagcccttgtgtgactcacaactccgtgtccttcctaaagtttcgggaagcagggttgtctaatatgcacatttcttattttggtcatatttttactttagtgtcactcaccttttacaaagtgactttgtactcatttagggctctatcggaaatgcttccattttgccttttctacagttaggccaattttgaaatatataaattctatgcaacatttatgttgagttaccaatggaagccaaaagttctcttcccaaactgccaagaatgatacaggccataattgaaatgggaataccttttaagtttcattaggggtggggtgggagtgggacaggaacaagacttgcctagatctttgttgtatcttggggacttttactttgttgtttgatgcttaaacttcaaaattctctgtattcaaatttgattgtggcgaatctacttcaaaaaggaaaaataatccaactttgtggatattaaatggaaggtttgctgttttgatctagttgtttccagtggagcagttttatgaaatatgttctataagatgtacattttttcattgtaacatagaaattgtaaataattgattaaagtgctgcattttgatgaattttttctagccatttttaaagagaaaactaggaattgagtattttgtgtacggtatgtttccatcctccctccccttcctcctcccctcctctctctctcttcctacctatttaattttcatttgtcatgaggtttttggatttgccaatgatctgctggacatcatgccccatgtcatagagaataaagctgatgattgtaccagtcttaaattattcatgattcaataaaattgatgcttatttattcaga

SEQ ID NO: 204 - DNA, 8925 bp, Homo sapiens
atttctgccagagcaccagagacgtcagcatctcaagggcactgtggtatggaaaaggacgccacatgagtaaattttaaaaatataaatattttaaagggtaaaaatgagggtccctgtatttgaggatataaaagatgaaactgaagaagaaaagataggggaagaagaaaatgaagaagaccaggtcttctataagcctgttattgaagacttaagcatggaattggccagaaaatgcacggaactcattagcgatatccgttataaagaagagtttaaaaagtccaaggataagtgtacatttgtgactgacagtcctatgctaaaccatgtaaaaaatatcggtgcttttatttctgaggcaaaatacaaaggcaccattaaagctgacctttctaattctctttataagcggatgccagccacaattgacagtgtttttgcaggagaagttacacagctccagagtgaggtggcctacaagcagaaacatgatgctgccaaaggattctcagattatgcccacatgaaggagccccctgaggttaaacatgccatggaggtcaataaacaccagagtaatatttcttataggaaagacgtgcaggacacccacacgtacagtgcagaacttgaccgaccagacatcaagatggcaacccagatctctaagatcataagcaatgcagaatacaagaaaggacaaggaataatgaataaagagcccgctgtaattggaagaccagattttgaacatgccgtggaagcttctaaactttctagtcaaattaaatacaaagaaaaatttgataatgaaatgaaggataagaaacatcattacaatcctcttgaaagtgcttcttttaggcagaatcagcttgctgctacactggcgagcaatgtgaagtacaagaaagacattcaaaatatgcatgatccagtttcagatctcccaaatttgttgtttttagaccatgttttgaaagccagcaaaatgctcagcggccgagaatataaaaagctctttgaggaaaacaaaggaatgtatcattttgatgcagatgctgtggaacatctgcaccataaaggcaatgccgtcctccaaagtcaggtgaaatataaagaagaatatgagaaaaataagggaaagccaatgcttgaatttgttgagacaccatcatatcaagcttcaaaggaggctcaaaagatgcaaagtgaaaaagtttacaaagaggattttgagaaggagattaaaggaaggtcatcactggatttagacaagactccagaatttttacatgtaaagtacatcaccaaccttctgagggagaaagaatataaaaaagatttggaaaatgagataaaagggaaaggaatggaacttaattcagaagttcttgatatccaaagagcaaagcgagcctctgaaatggcaagtgagaaagaatacaagaaagacctggagtcaataattaaagggaaaggaatgcaagctggcactgacacccttgaaatgcagcatgccaagaaggctgcagagatagcgagtgagaaagactataaaagagatctggagactgaaattaaagggaaagggatgcaggtgagcacagacactcttgatgtccagagagctaagaaagcatccgagatggccagccagaaacaatacaagaaggacttagaaaatgaaattaaagggaaaggaatgcaagtgagcatggatatcccagatatccttcgagccaagaggacatctgaaatctatagccagagaaagtataaagatgaagcagagaagatgctttctaactattctaccatagcagatactcctgaaattcagagaattaagacaactcaacaaaacattagtgcggtattttataagaaagaagtgggagctggcactgcagtgaaagatagcccagagatcgaacgagtgaagaaaaatcagcagaatattagttcagtgaaatacaaagaagagattaaacatgcaacagccatttctgatcctccagaactaaagagagttaaagaaaaccagaagaacatcagcaatctccagtataaagagcaaaactacaaggccactccggtaagcatgaccccggagatagagagagtgaggcgaaaccaggagcagctgagtgcggtaaaatataagggagaacttcaacggggaactgcaatttctgatccaccagagctgaagagggcaaaagaaaaccagaaaaacatcagcaatgtttattacagaggtcagctgggaagagctaccactttaagtgtaactcctgaaatggaaagagtgaagaagaatcaagaaaatattagctcggtaaaatatacccaggaccataaacagatgaaaggtagaccaagtctgattttagatacacctgctatgagacatgttaaagaagcacaaaatcatatttcaatggtaaaataccatgaagattttgaaaaaacaaaggggagaggctttactcccgtcgtggacgatcctgtgacagagagagtgaggaagaacacccaggtggtcagcgatgctgcctataaaggggtccaccctcacatcgtggagatggacaggagacctggaatcattgttgacctcaaagtttggcgcacagatcctggctccatcttcgaccttgatcccctggaagacaatattcagtctagaagtctccatatgctctctgaaaaggcgagtcactataggcgacactggtctcgatcccattccagcagtactttcggtacaggtctcggagacgacaggtcagaaatctccgagatttaccctagcttttcatgctgcagtgaggtaacaagaccgtctgatgaaggagcacctgttcttcccggagcctatcagcaaagccattcccaaggctatggctacatgcaccagaccagtgtgtcatccatgagatcaatgcagcattcaccaaatctaaggacctaccgagccatgtacgattacagtgcccaggatgaagacgaggtctcctttagagacggcgactacatcgtcaacgtgcagcctattgacgatggctggatgtacggcacagtgcagagaacagggagaacaggaatgctcccagcgaattacattgagtttgttaattaattatttctccctgccctttgagctttattctaatgtatcccaaacctaatctttttaaaagatagaagatacttttaagacaacttggccattattttacaatgatgtatccttcctttgacaattagacacacaggtaccaggaagaaggaatgacctctgggctgaaaacagcagcattttcagtaattcctacaaacaaaaatctttgtgtctggacacctggtgctgctaattgtgttcatggtttcctttgattggctattgaacccttctgggaaatgtatttttgtagactttaatagagaagttgattgtcccttaaatgtagtgtgtgtttgaaacttcttagctgtcactttggaatcaccccaagccaattctcttaactctgtaatgcagccaataatttcaaacccgttttgcttttgagtcatgaggcaatttccaatattagtgaaaattgcccaatataataagtgtaaacagtggcagaaggacagtctggttaaaattatattgactggtggccttagggatctagaaacttctactaaacagagaaatttccttgttccctaggctgactggtatctatttatttctcatttgtaccaaggcatctcctactctccatttatattctatggacccaagtctatgctcagttccacagaatgtcaggaccaaataacttcacagctactctgcaaagggcaaattataatgtcattgatataatttccctagtagcatttaccctgttgcatgtcatgtagattcaagcttctgtaacataggcagctgcactgcgcgttcctattattgaagcaaaaagggtgactgatacctaaaagccctttcttcctctagtcgccagctcatcagaaaaacatactttgaaaagatgcttgagattttcctgctgcatcgcactctagttttgaaggatttacatcttaggaaataacatgtatactctagtaaataagcgatttaggtgttccattgaacagctttgattaacttaatgccaccattgatttcaaagtgaagaaaatgtaacagaagccagtgaagcaatggaagctggagtgtgactggaaaaatactcagcaaacaaagttaccaattccatacagagatgatctggtatcttcttttggaaaatggtattcaaattctggaatggaaatctagccaccaaaacgggttaatcaaaagacgtccttttccatttttttttgcttttattttctaaatcatttttaagggaatgaaacaggaatgtcatcagagattttttagtacaggcccaagagcctgttctctaagaaagaaattgttgccatgttttgattttcgaataagtgactttgcaggctttatgctagcccttgctggtgggtcttgaaatttcatccagagtctgcagtccaggtcaccaagccagcggcacccgtcggcaaccctgtgtttttctgattgtgccgtttactgtgacctgcaacggggtggcattcacttagggtctgacttcacagctatgacaaaaccgaaaaagcaaaactgcaaaaaagtactaagatgtacgggtcttggggatatctgccttatatgttatattcaaggaaattaacaaaacatcctgtaaaacatcgtttaaggaaacgtttactagtccaaaggccaaagctaatttatttccactttagaaaagttagcacatgcttttgaaaatctgtgatttcattttattaggctaaaagggtaaataggctttattacactgaagctgcatctatatgtcactgacataaagttgaaaaaataaatgcaggcaaataactagagacttcttttaagggggtttggctggttttctctcactgaaatggccagtcgtgattaaagtgataaaaccccatatctgttttggtatattgtacacaaacctacaaaaataaactgaacttgcaatatttttgcaaaaaaatctgtcgttaaaactgaggataaaatacctgctcaattttattttactaagtatatatttacatttcacccaggcaggccattttcttttgtgattataagaaagagtagttgttgattaaattttcagactaaatataggacaggtacaattttggataaatagcacatttataagaaccgcaatgaaaactgacttgaaataatgcttgtaatcaggaaagtaatttcatccaccgatttcaaaaccagattcactgagcataaaagtcaatacatatttgaggaataagtctcctaaaattttaagcttcacgtaataatgtttgcatagcaaaatatttctgcttcaagcctttaggaattaagatctgatcagaatttaactaaagggtagttgttttacaatgaagactaaaactgaacaagatgttgcatgctcttgaggccataatttggtagtgttggcagttgttaataaagcttgtcaggatgttaagcatctcaggagaaatattggaaaattatatgtataaaaccaaagtgctatttttaaaagcatcatttaaaaaaaaatgacatgcctgaacaacttttccactttccacgtgcttccctcccacctttggtttggcaacaggtatctcgtgcatgaagctgacagctaaagaagattttaaaaattgagttaaagatgactgtgtaaatgtccaagcacagagagcatgcacctgactttctaaagtttgatgtgttctcaagcctgacagaagcacaaggaacagtttgatacacttttaaaaggttctgaaaacaaagctgtatagggatcctctctctcttgagcaaagtatagcaacagaatatattgcttttgttgtaagcttttgtagtacatgtttttactaataattcttgttctctagaaagctttctatttctaacctatggcaaaatgaatccttcatgtcttcttgttattgtttacacacttgcagtgtagcccagtttgaaatatttatttggttatcaactgcccatggaggaggctcttgatgatcccaggtctcctcgacctccatacaccacacaggcatttgtaagcacagtttccacaagcaccttgtaggaatatggataagattagaccagcccctctctgtccactgggtttatttcttgaagaagatgcagatctggtttttccaatgtgccacagtctttccttatcctctccatgctgagcttgacaacactctgggaatgaggaacaagactttttctaaaaagatagtggaagttcaagggatgtacctcgttttcaggttcatccatctccagtggaatgttttcaataaaagatgaagaaaatgtgtgtgatctttaataacacatccctatagaaagtggataaaagatataccaaaactgtaatacagatatatacaaatataggtgcctttttgattactcttgtttgtctagtatgctcttggaaagaaaaccaagcaagcaagttgctgcctattctatagtaatattttattacacatgattgatatttttgtggtagggaagtgggatgctcctcagatattaaaggtgttagctgattgtattttatctctaaagatttagaactttagaaaatgccgacttcttccatctatttctgaaaggttctttgtggatttatatagagttgagctatataaacattaactttagatttgggatttaaaatgcctattgtaagatagaataattgtgaggctggattcactacacaagatgaacttcacttcataaattaattataccttagcgatttgcttctgataatctaaaagtggctagattgtggttgttttggttaaggtgatatggaggtgggagagcttttagttaagtaagaagctatgtaaactgacaaggatgctaaaataaaagtctctgaagtattccatgccttttggaccctttcctcgcaactaactgtcaactgttgatcaaaaaagtcaaggcattgtatgttgcttctgtggttattattctgtgatgcttagactacttgaacccataaacttggaagaatctttgagcaaattttctcagttgtctgtatgacttcagtatattcctgggaatgccataggattttttgtgcttgatacatggtatccagtttgcatagtatcacttctttgtaatccagttgctgttaagaatgatgtactttaaaggaaaagagaaaactgcatcacagtcccattctccagtgtccatgcaatgaattgctgagcatttaggaagcagcaccaagtctattacaggcatggtgtgaaacttgatgtttgacctgtgatcaaaattgaaccattgtacagtttggcttctgtttgcttcaaaatatgtagaattgtggttgatgattaatttgcgagactaactttgagagtgtaacagttttgaagaaaacattgaatgttttgcaaatgaaggggcttcacggaatgttacaatgttactaatataatttggcttttgttatgcaaattgttaacaccagctattaaaatatattttagtagaaatgctttaattcatatttttttcctctacactgtgaatctttaagccttggtggactagagcaacatcgtgctgcccaaaggactaacctatgcaaactagttcacattttagtggatgtcgcagttaatgtgtaataagacattatttcccctgcataatgtacaacagcattgaaatgacacattaagcctagcatcacattgtatagtacagtcactcacaaacccttcaaggctaccctaatcattaacattaatatttgtttaaaagcaaatcaccgatttatctattgaaactacttaaatgacggcaaaccaggaatgacagatggctgtgtcagcaatggctttaatgtgttccctgcaagtggtctcctatgatagaactgcgttctcaaatgcactctcttcagggtcttaatattctgtgttttctctctgtatttgtaaaacattataacacattaatttcctatctctacacatttggtttgcttaaataaatgcaggatataaaaaaaatggttcacttcttggctctcaccgtggtttcttggagcatgggttgttagatgcaagcaatgcaccctaataataccccgggtctgagatttaacatgacaactcacatcaaatcgcatcagaggtgtgtgctgccttcagtgcatttacattggtgaatcagtcaagatattttcctcccccaaataaacttagttgtaagtgataacaatattatgcttctccaagctcagtatctttctgattttatatcaaagtaccgcaacaatgcatcattgtagttaatttatttcaagaataaattcctcatatgtcctcaatagtacaattctaattttcttctattcataagatgaaagaaatggtttggagcatagaatagaaagtgcacaaattgagtacataaaatgggaagcaactgatttctcagctaagaaaggctcatttatcacagaacacaattgcttttctccccccactacgcttcccataattgaaaaagtgagtccctatttttcacactcatataaatctatgcgatttggatgctagtcttattgtattattttgtaaaactttctctttggctcataatccttcctaattgtaaattgataaactttgcggatgacatctgctcgtagaataaacacttcttccaaa

SEQ ID NO: 205 - DNA, 2679 bp, Homo sapiens
gtgttcgctgctgcacagcaaggccctgccacccaccttcaggccatgcagccatgttccgggagccctaattgcacagaagcccatggggagctccagactggcagccctgctcctgcctctcctcctcatagtcatcgacctctctgactctgctgggattggctttcgccacctgccccactggaacacccgctgtcctctggcctcccacacggatgacagtttcactggaagttctgcctatatcccttgccgcacctggtgggccctcttctccacaaagccttggtgtgtgcgagtctggcactgttcccgctgtttgtgccagcatctgctgtcaggtggctcaggtcttcaacggggcctcttccacctcctggtgcagaaatccaaaaagtcttccacattcaagttctataggagacacaagatgccagcacctgctcagaggaagctgctgcctcgtcgtcacctgtctgagaagagccatcacatttccatcccctccccagacatctcccacaagggacttcgctctaaaaggacccaaccttcggatccagagacatgggaaagtcttcccagattggactcacaaaggcatggaggacccgagttctcctttgatttgctgcctgaggcccgggctattcgggtgaccatatcttcaggccctgaggtcagcgtgcgtctttgtcaccagtgggcactggagtgtgaagagctgagcagtccctatgatgtccagaaaattgtgtctgggggccacactgtagagctgccttatgaattccttctgccctgtctgtgcatagaggcatcctacctgcaagaggacactgtgaggcgcaaaaaatgtcccttccagagctggccagaagcctatggctcggacttctggaagtcagtgcacttcactgactacagccagcacactcagatggtcatggccctgacactccgctgcccactgaagctggaagctgccctctgccagaggcacgactggcataccctttgcaaagacctcccgaatgccacagctcgagagtcagatgggtggtatgttttggagaaggtggacctgcacccccagctctgcttcaagttctcttttggaaacagcagccatgttgaatgcccccaccagactgggtctctcacatcctggaatgtaagcatggatacccaagcccagcagctgattcttcacttctcctcaagaatgcatgccaccttcagtgctgcctggagcctcccaggcttggggcaggacactttggtgccccccgtgtacactgtcagccaggcccggggctcaagcccagtgtcactagacctcatcattcccttcctgaggccagggtgctgtgtcctggtgtggcggtcagatgtccagtttgcctggaagcacctcttgtgtccggatgtctcttacagacacctggggctcttgatcctggcactgctggccctcctcaccctactgggtgttgttctggccctcacctgccggcgcccacagtcaggcccgggcccagcgcggccagtgctcctcctgcacgcggcggactcggaggcgcagcggcgcctggtgggagcgctggctgaactgctacgggcagcgctgggcggcgggcgcgacgtgatcgtggacctgtgggaggggaggcacgtggcgcgcgtgggcccgctgccgtggctctgggcggcgcggacgcgcgtagcgcgggagcagggcactgtgctgctgctgtggagcggcgccgaccttcgcccggtcagcggccccgacccccgcgccgcgcccctgctcgccctgctccacgctgccccgcgcccgctgctgctgctcgcttacttcagtcgcctctgcgccaagggcgacatccccccgccgctgcgcgccctgccgcgctaccgcctgctgcgcgacctgccgcgtctgctgcgggcgctggacgcgcggcctttcgcagaggccaccagctggggccgccttggggcgcggcagcgcaggcagagccgcctagagctgtgcagccggctcgaacgagaggccgcccgacttgcagacctaggttgagcagagctccaccgcagtcccgggtgtctgcggccgcaacgcaacggacactggctggaaccccggaatgagccttcgaccctgaaatccttggggtgcctcgaggacgactggccgaaaagccgcattccctgcctcacaggccggaagtcccagcccagtccccgcgcgcgtccctcttcctcctcatactttcccttgactgagagctcctctaacccctgttctgatgggggagggcggtcttcccacttcctctccagaactccagaaagagcagtgtgcttatgcttcagtccaggctggagaggttggggccggggtagggaggcaggagccatgtcagttctgaaggagggtgaggcggtgggggattgcagggggcggctgagagaaaacctccttgggggccagggattccctttcccactctgaggctctggccagagggagagaggactctggacctaggaaaagaggcttttggctccaggtggtcaggacagtgggggttgggggtggggtgggtgggtgctggcggtggggaccaagatccggaaagatgaataaagacaaacatgacaaactaa

SEQ ID NO: 206 - DNA, 8219 bp, Homo sapiens
agcccgaagtttcctgcgccgcgcgcggacgggctcgaggctcgctcgctgcctcaccggtccccggcccgcgccccgcgccccgcgccccgcgccccggcctcacccgtccgctcagcggcctccacgccgcgccgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcagactggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagcactttccccagcccagaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaa

SEQ ID NO: 207 - DNA, 5618 bp, Homo sapiens
ggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 208 - DNA, 2925 bp, Homo sapiens
gactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaa

SEQ ID NO: 209 - DNA, 820 bp, Homo sapiens
actcgccacctcctcttccacccctgccaggcccagcagccaccacagcgcctgcttcctcggccctgaaatcatgcccctaggtctcctgtggctgggcctagccctgttgggggctctgcatgcccaggcccaggactccacctcagacctgatcccagccccacctctgagcaaggtccctctgcagcagaacttccaggacaaccaattccaggggaagtggtatgtggtaggcctggcagggaatgcaattctcagagaagacaaagacccgcaaaagatgtatgccaccatctatgagctgaaagaagacaagagctacaatgtcacctccgtcctgtttaggaaaaagaagtgtgactactggatcaggacttttgttccaggttgccagcccggcgagttcacgctgggcaacattaagagttaccctggattaacgagttacctcgtccgagtggtgagcaccaactacaaccagcatgctatggtgttcttcaagaaagtttctcaaaacagggagtacttcaagatcaccctctacgggagaaccaaggagctgacttcggaactaaaggagaacttcatccgcttctccaaatctctgggcctccctgaaaaccacatcgtcttccctgtcccaatcgaccagtgtatcgacggctgagtgcacaggtgccgccagctgccgcaccagcccgaacaccattgagggagctgggagaccctccccacagtgccacccatgcagctgctccccaggccaccccgctgatggagccccaccttgtctgctaaataaacatgtgccctcagg

SEQ ID NO: 210 - DNA, 1436 bp, Homo sapiens
cagtcacacaagaagggaggagagaaaagccatggccgacaaggtcctgaaggagaagagaaagctgtttatccgttccatgggtgaaggtacaataaatggcttactggatgaattattacagacaagggtgctgaacaaggaagagatggagaaagtaaaacgtgaaaatgctacagttatggataagacccgagctttgattgactccgttattccgaaaggggcacaggcatgccaaatttgcatcacatacatttgtgaagaagacagttacctggcagggacgctgggactctcagcagatcaaacatctggaaattaccttaatatgcaagactctcaaggagtactttcttcctttccagctcctcaggcagtgcaggacaacccagctatgcccacatcctcaggctcagaagggaatgtcaagctttgctccctagaagaagctcaaaggatatggaaacaaaagtcggcagagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttcggacatgactacagagctggaggcatttgcacaccgcccagagcacaagacctctgacagcacgttcctggtgttcatgtctcatggtattcgggaaggcatttgtgggaagaaacactctgagcaagtcccagatatactacaactcaatgcaatctttaacatgttgaataccaagaactgcccaagtttgaaggacaaaccgaaggtgatcatcatccaggcctgccgtggtgacagccctggtgtggtgtggtttaaagattcagtaggagtttctggaaacctatctttaccaactacagaagagtttgaggatgatgctattaagaaagcccacatagagaaggattttatcgctttctgctcttccacaccagataatgtttcttggagacatcccacaatgggctctgtttttattggaagactcattgaacatatgcaagaatatgcctgttcctgtgatgtggaggaaattttccgcaaggttcgattttcatttgagcagccagatggtagagcgcagatgcccaccactgaaagagtgactttgacaagatgtttctacctcttcccaggacattaaaataaggaaactgtatgaatgtctgtgggcaggaagtgaagagatccttctgtaaaggtttttggaattatgtctgctgaataataaacttttttgaaataataaatctggtagaaaaatgaaaacttgtcctcatttttctcccacactgaagaaacagggactggaacttagagtgactaaggaattt

SEQ ID NO: 211 - DNA, 5171 bp, Homo sapiens
acaaaggagggaaaatgagccgggcggcggcggcgcggcgcggggccaccacggcggcggcgagcgcggccgcccccggcaccacgtaaaccgcccccgcccgcccagctgcggcccaggccggagcggagcctgccgtcctccgcctgcctgctgctcgcctccctagacctgcgcgtcgcttcccggcccgccgaggaggtggtggaggaggaggcgccgctttccccgcggcgcgcgccctcgccgttgtctgagctgtgcctggaccagtttggggaagttgtcggggctccgcgtcgcccagatgtgtgacctcattgagccgcagccggccgagaagatcggcaagatgaagaagttgcggagaactttgtcggagagtttcagtcgcattgctttgaagaaagatgacaccacctttgatgagatatgtgtcacaaagatgtctacacggaactgccagggaatggactcagtgatcaaacccctggacacaattcctgaggataaaaaagtcagagttcagaggacacagagcacttttgacccatttgagaaaccagctaatcaagtaaagagggtgcattctgagaacaatgcttgcattaactttaagacctcctccactggcaaagagtcacctaaagttaggcggcactccagccccagctcgccaacaagtcccaaatttggaaaagctgactcatatgaaaagctggaaaaactaggggaaggatcttatgctacagtatacaaagggaaaagcaaggtaaatgggaagttggtagctctgaaggtgatcaggctgcaggaagaagaagggacacctttcacagctatcagggaagcttctcttttaaaaggactaaaacatgctaacatagtgctacttcatgacatcatccataccaaggagacgctgacacttgtgtttgaatatgtgcacactgatttatgtcagtacatggacaagcaccctggggggctgcatccagataatgtgaagttgtttttatttcagttgctgcgaggtctgtcttacatccaccagcgttatattttgcacagagacctgaaaccacagaaccttctgatcagtgacacgggggagttaaagctggcagatttcggtcttgcaagagcaaaatccgtccctagccacacatactccaacgaagtggttaccttgtggtacagacctccagatgtccttctaggctcaacagaatattccacctgccttgacatgtggggagtaggttgcatctttgttgaaatgatccaaggagttgctgcttttccaggaatgaaagacattcaggatcaacttgaacgaatatttctggttcttggaacaccaaatgaggacacatggcctggagttcattctttaccacattttaagccagaacgctttaccctgtacagctctaaaaaccttagacaagcatggaataagctcagctatgtgaaccatgcagaggacctggcctccaagctcctacaatgttccccaaagaacagactgtcggcacaggctgccttgagccacgagtattttagtgacctgccgccacggctatgggaactcaccgacatgtcttctatttttactgtcccaaatgtgagattgcaaccagaagctggagaaagcatgcgggcctttgggaaaaacaatagttatggcaaaagtctatcaaacagcaagcactgacaagcagcacattctcaagagcacacaggattaagttgtcatcattctgggaagaaaaaaaaaacattaatgaagaggccaataatatgaagggaatcatggatcagttttctttcgctccctgtggtggatttcacttacaagaaaattgaagctggcaagaccctgttttctctgcaatttatttaaaaccttgcacgcatttggataccttgtgatttccaagaactacgtgaagattaagctttgcttactgatacatggcatgtattcttttcagtcttttgtgtttgattttgtttgatttccctctgcagcacagcgtctctgtaaaggtttttatgctttcaccagccatgtcttaaatacattaagacaacacatttggtgttcacacttcttcagtaatgtctgaacttgaaagccacagagtggcataaaacaatgtgtgttttctttgagagcagtgcacattttgcaaccactaggaaggaaattttctgctaaagcaaacccctgttctctgacttgacaacttggccccggactgtggggccccacctgttgcttaccttttgaggtaattttgcaaatgtggtttttttacttggaaataactgcacatttatatataggatattggactctgcttagcattttcaagccacatagcatgactgttttttgaataggttggaattgaaaaaacaattatcaaacgttaagaacaaagacagggataaattgcttacatttcaacctctggagattgaggtaactttttgtgtctgggtcttgtcaacatctaatttttttccatccattctgttacactttgtattttctaactggagaaaagagtgaggaacagaatgttttaaatctggtgcaaaagaactatatctgctggatgagccttgaaagcagtcttggcctgttagggcttacaaagtaaattacaaagtgatccagttcaaagtttgcttagttacaacaaagcacctttaaaaaaaatacattttaaaaaaacattccaagccaattggaagacatcattgggttcttactttaagacatctcctggaataactgttcaaatgcaggttttagaaacaatgcaggaatcttgctttaaagatgaaaaagggaatgggccagcttcccttactcaaggagttgagggaccttggaggatgaaggcgagtatgtgacactggagaaaagtggaccaggcatgtcttttgctttgatctggagggagggctgcctgatgcaggccggctcccagtggggcaggcctcgctgcagaatgcccagtagtactgcggccaaggggacagttaggagacttcatctaaagcatgaaacctagctcctctacacacaaattcctatggaaatacctttgtgtacagtgtcttacattttcctattagtcagaaagaaggagagaatgagtgagtgcttgaaatgtgtcatactgttttaggatcaagactaggaattaggagccaggttgacaaggactttttctgagagttgggtgagggtaaagcttttctataatcaagctcaatacaccaaggaaactggatccagaattcctaaactttaaaatggtactgtctgcggagtggagtatggatggttatgtcaaagtcatagttcatcctatccagatgtagcattcatggtaaacttttaagtgctaagcaaggaattatttactgattggttttaaagagagcagaaaacacccaagtgtagaatgtctactgtttgctacctagaaatcttttccattcctctttcatacattccaacccactggaagtctttagaggtattttgatttaaagtatacttaaattaggatttcttaaagaaaacatagggagaaaactttacatgcaattaaaaatggactttcctgtgatttgtttttaatcattcatttggagaagaggcatgacctttgtatttcactaagtttaaagcaagagcaactgatgattaaatgttgctttttaataaggtttttaacttgaaaatttgaaaatatttaatgttgaaagacttcaattagggctattagagttatatctccctgtcgtaggcagcttcttcggagaagtgaaatataacattactcagtggacggagaaatctgttttgttacagagacatgcctctcagaaggtcaggaggttttgagtacctatccttgccacccatacaggaaatccaaagtttggtgtctctctctctctgtctctttctttctctttctccccccaaacccctctcactccctccctccctctctccttcccctatttgcaatcatattctccctctgcttcttttctcttctgccctccttgtgggcagtcatgaaaatcaattcagactgtgttgattagcagatttattattctattgagaaagcactggaatgttttgtgagattatttttatatgaaggaatagcctgaactcaaacagatggtaagaatagtacaaacaccttagcacatcactgcacacacagtattctgaaaggagatttgacacttaattcccattttcttaaaataacagttttgttgacttaaaaatatgagatacataggatgtgaaaaaaaatgtttgcagtactcagcaaaaaatagggtacataaagcagggtggctgtccatccactgattctggggtgagaagcgatttctacctcgcaagagtgactagaaagtttctaggagcacctccaggcttgcaaagaaagtgaggcctcttggtatcctttcctcagtgtgtatatgacagccagtataatcaataccctaggttatgcgtctatatgatactcatctgtgaatattattggttttgtaatctttgttatataagaggatgtttaggctgtatatactggggtagattattgcctgccccttatacataggaatatgctgcataattgcgcataacttccatctcccttactggcttgtaggcagaggaaactgtatatgttactgccttgtacttttctcatacaccaaaaacacaccaaaaaaatcaataaaataagcaatcttctattctcattccttttcccacagcagcatattttagaggcacatacaaaacctacattctctagttgggagtggatttttaaagttttccttttatcttttatttttttttgtatgatgcactgagatgtgtactttctaacaggggattggtacctaagaaatgtggtagcattattcagaaaactattatactttcaaatgacacatagtaaggagaatggaataatacatgttgcatatttgttaccagttgtaatttgtctgtattatgaaagatgtaatggtttgtcagctgtcactgttgttttcttgtaacatgatatggaataaagtatagcagaatctccgta

SEQ ID NO: 212 - DNA, 3583 bp, Homo sapiens
gtcctaatagccacgcccacctcaaatggcgatcccagagagcatctggcttcaattttcctttttccggaggggagatggattccctggaatggaactgggctctggtgtatgagctcagtggagagcaccatgacgaagagtggtcagtgaagacttaccaggaagtagctcagaagtttgtggaaactcaccctgagtttattggaatcaaaatcatttattcggatcacagatccaaagatgtggctgtcatcgcagaatccatccgaatggccatggggctccgaatcaagttccccacggtggtggcagggtttgacctggtggggcatgaggacactggccactccttgcatgactacaaggaagctctgatgatccccgccaaggatggcgttaagctgccttacttcttccacgccggagaaacagactggcagggtacttccatagacaggaacattctggatgctctgatgctgaacactaccagaatcggccatggatttgctttgagcaaacaccccgcagtcaggacttactcctggaaaaaggacatccccatagaagtctgtcccatctctaaccaggtgctgaaactggtgtctgacttgaggaaccaccctgtagccactctgatggccactgggcaccccatggtgatcagctctgatgacccagctatgtttggtgccaaaggcttgtcctatgatttctatgaggtcttcatgggcattggggggatgaaggctgacctgaggaccctcaaacagctggccatgaactctatcaagtacagtaccctgttggagagtgagaaaaatactttcatggaaatctggaagaagagatgggataagttcatagcagatgtggctacaaagtgaggagaagctagccagccctctacaagctgtcttcttgcacacgctgtcacttcctctcactcgttcttgaatcagctccatgtgcccatgaaatcaatggcctctgtatggagcgaccctgtgagaagcacttggctggctgagcaaattcatcctctggaaatattctctctcagccacagtgacattgaccctcttggttttctcctgtctctggccatttcttccagtttccctatttcagagtcttctcctctctctgatctctgtgctgtttcctcaggactcagtcctgggctctcttctattctggtctctttatttttttatttttgtattttttcgagatggagttttgctcttgttgcccaggctggagtacaatggtgcgatctcagctcagtgcaacctccgccacccgggttcaggcaattctcttgcatcagcctcgcgagtagttggaattataggcatgtgccaccacacccagctgatttttgcatttttagtagagacaggttttcaccatgttggcgaggctggtatccaactcttgacctcaggtgatccactcgccccttggctcccaaagtgctggaattacaggcattagccaccatgcctggcctattctggtctctttaactctctcctctttatttctcttctctctctgtacacttttcctgggtggtctcatccattcctttgctttttcataccatttatttgttaatgattcccacatttatttatgcacttggagagctcacaggaatctcagaaactgatgaggtacaattctgaaccctcagtctcttccctttaaacctttctttttctctactttaatttttctaaagagtgtcttgctatgttgcccaggctggtctccaactcaagtgatcctcctgccgcagtctcccgaagtgctgggattactgacatgagccaccacactcagccctttaaacctttccctggcctttcccatagctggtgaaggacacctccatccattccacgcagttgctcaaagcagaaattttcagtgcaagtcttgatgctgcgccgtcccccactccctacatcagaacgcatccctcatctggactccagcggtggcttcttgatgctgcgcggtcccccactccctacatcagaatgcatcccgcatccagactccagcggtggtgctctacctgcacgctgttgccaagtccaagctaccatactcctgcctgagctatgacaacagcctcctcactgatctcccctttcttccctttgcctcctccagctcatttttcacagtgtagaatgacattttgtttgtttgttttgttttgtttgagatggagtctcgctctgttgcccagggtggagtgcagcggtgcgatctcggctcactgcaacctccacctcccgggttcaagcggattctcgtgcctcagcctcctgagtagctgggattacaggcatgcaccaccatgcccggataatttttgtatttttagtagagatggggtttcactatgttggccaggctggtctcgaacacctgacctcgtggtccacccgcctcggcctcccaaagcactgggattacaggcgtgagccacccggcctggcctagaatgacttttaaaagatcaaattaaatcaggtcactcctttgcttacaacgcagtgcgtttagaggtacaccccatgtctccacagggcatacagcatccgatttaatctggatccattccggcgccttcctctcccagtcacccagagggccccaaccccggcggccctttcttcctcaaatgtcctcggctctataccgtgcctgggtcttttctctttctctctgcctggaagattccttctttccccttttgtcttgcccactcctgtttacccttcaagtttcaagttcatgtcactgtctcagagaggttttcctgtgctcgccctgtttctctcaggaagccttgctcttttccatcatgcctctaatcacagcttataatcggatatttatttctgtgtctacagtcttgccctgccagactgtatgccccatgtgggcaggcgctcatgattgtttctgattgtttcacgcatgctgctaacccagagcctgggcccaaagctagttagtactcaataaacaatgcattgaatgagtggctgtcactgtgtctgttcagccagctgccaaggcagaggggagtagagcagagccgccccaaataaaagacctcatgtgatcagagtccagctcctcacctggccttggaagaaggatgcaagaagccacctctgtcctcacccaactcaaggatggcagggaatcaaagaattcctcaaaagccccaggcgaatgtcctctcatccatcttccatgacctgtacctgagctctcagacagcagcaagccctctctccattcctagtttatcaccatttggttcctggaactgggaaaaaacagcaaccataagctgtgcctggatggaagaagacaacctctagggtcctgtctaactctgcaggtgattcagtgccttacccaatccctgaagatcttttaggtcccaactgcgcaggggacctccaacacaggcagacgcaaacagcctctggcctggacttgctgtgatctctgatttggcaaaatgaaccagcaatagtcttgc

SEQ ID NO: 213 - DNA, 13593 bp, Homo sapiens
agttaccaagctcggtgaaggagacaagttcccacagctgactcggctcggctctcccaccttcccggcagcggccgcgagccctgattgtatccctcgctttcctcgtgggggagcacggactgacttggctgaagaaaatgccagttctgtggatgtggccgtgacaagaggacgtgcggctggaagaggcagaaggggacgaggaaaagcatgctttgaagagaagaataaaccagcgaccccaaccctttctgcaaattggtgctattacttgtgggatccatttgctttcattccctcccaccccaccgctgaagaaaccttgccctgagggctgagagccagccccctgcagccgggggacgcttctgggttggaggaccttctggatgtagcgtcggtggaacctttagatactctcctctggaaaagccaccatgaattcggtagctgggaataaagagaggcttgcggtctccaccaggggcaagaaatacggggtgaatgaagtctgctcgcccaccaagcccgcagcgcccttctccccggaaagctggtaccggaaagcatacgaggagtcgcgcgccggcagccggcccactcctgagggcgcgggctcagcgctcggctcctcggggaccccgtctcccggctcgggcacctcgtccccgagctcgttcaccggctccccgggacccgcctcccccggcatcggcactagttcgccgggctccttgggcggctctccgggcttcggcacaggctccccgggctccggcagcggcggcggctcctcccccggctcggaccgcggcgtctggtgcgagaactgcaacgcccgcctggtggagctcaagaggcaggccctgaggttgctcctcccggggcccttcccgggcaaggaccctgctttctcggctgtgattcacgacaaactccaggtccccaacaccatccggaaggcatggaacgaccgggacaaccgctgtgacatttgcgccactcacctgaaccagttgaagcaggaggccatccagatggtgctgacgttggagcaggcagccggcagtgagcactacgacgcctcgccctgctccccgccaccgctctccaacatccccaccctggtggggtcccggcacgtgggtgggctccagcagcccagagactgggcctttgtgcccgccccctgtgccacctccaactacacaggcttcgccaacaagcacggcagcaaacccagcagccttggggtcagcaatggggcggaaaagaagagcgggtccccaacccaccaggccaaggtcagcctccagatggccaccagtccaagcaatgggaacatcctcaattcggtggccatccaggctcaccagtacctggatggcacctggtccctgtcgagaaccaacggggtcaccctgtacccataccagatctcccagctgatgacagagagtagccgggagggactaacagaagcagtgctgaaccgctacaatgcagacaagccttccgcctgcagtgtcccagcctcgcagggctcctgcgtggccagcgagacttccacaggcacatcggtggccgcctccttctttgcacgagctgcccagaagttaaatctgtcttctaaaaagaagaaacatcggccttccacttcttccgctgccgaaccaccgctctttgcaaccagcttcagtgggattctgcagacctcccctcccccagccccaccctgcctgctgagggctgtcaacaaggtgaaggacaccccggggctgggcaaggtgaaagtcatgcttcgcatctgttccaccttggctcgagatacttcagaatccagctctttcttaaaggtggacccacggaagaagcagatcaccttgtacgatcccctgacttgtggaggtcaaaatgccttccaaaagagaggcaaccaggttcctccaaagatgtttgccttcgatgcagtttttccacaagacgcttctcaggctgaagtgtgtgcaggcaccgtggcagaggtgatccagtctgtggtcaacggggcagatggctgcgtgttctgtttcggccacgccaaactgggaaaatcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcagctgcagaaccagagcgagctgcgggcccccaccgcagagaaggctgcctttttcctggatgccgccattgcctcccgcaggagccaccaacaggactgtgatgaggacgaccaccgcaactcacacgtgttcttcacactgcacatctaccagtaccggatggagaagagcgggaaagggggaatgtctggaggtcgcagccgcctgcatctcattgatctcggcagctgtgtgaaagctcttagcaaaaatcgagaaggaggctcagggctgtgtctctcgctgtctgctctgggcaatgtcatcctggctctcgtcaatggcagcaaacacattccatacaaagagagcaagctcgccatgttgctgcgggagtctctggggaacatgaactgccgtaccaccatgatcgcgcacatctcggccgcggtcgggagctacgcggagaccctgtccaccatccagattgcatcgagagtcttgaggatgaagaaaaagaagacgaagtacacatccagctcgtccggcggggagagctcctgcgaagaaggccgcatgcgcaggcccacccagctgagacccttccacaccagggccacggtggaccctgacttccccatcgctcacctgtccagcgaccccgactactcctccagcagcgagcagtcctgcgacaccgtcatctacatcgggcccaacggcacggccctctctgacaaggagctcaccgacaacgagggccccccagactttgtccctatcgtgccagccctgcagaagacccggggcgacagccggcccgcagaggcaggagaggctgcagccggcaagtcagaaagggactgcctgaagtgcaacacgtttgccgagctgcaggagaggctggactgcatcgacggcagcgaggagcccagcagctttcctttcgaagaactgcctgctcagtttgggccagagcaggcaagcagaggcccccggttaagccaagcagcgggggcaagcccactctctgagtctgataaggaagataatgggtccgaaggtcagctgaccaacagagaaggccctgaactcccagcctccaagatgcagaggagtcactcacctgtgcccgccgcggcacccgcccacagccccagcccggcctcacccaggagcgtcccgggcagcagtagccagcacagcgcctccccactcgtgcagagccccagcctccagagcagccgggagagcctcaactcctgcggcttcgtggaaggcaagcccaggcccatgggctccccccggctgggcatcgccagcctgtccaagacctcggagtacaagccacccagctctccttcccagagatgcaaagtctacacccagaagggggtcctgccgtctcccgccccactgcctccctcgagcaaggattccggcgtggcgtctagggagtccttgctgcagcccgaggtgcgtacgcccccggttggaatgagcccccaggttttgaaaaaatccatgtctgctgggagcgaagggttcccggaaactcctgtcgatgatgagcagcaggcagctactccttcagagtccaagaaggagatcctgagcaccacgatggtgacggtgcagcagccactggagctgaacggtgaggacgagctggtgttcacgctggtggaggagctgaccatcagcggggtcctggacagcggccgccccaccagcatcatcagcttcaacagcgactgctctgcacgggccctggcctcgggctcgcggcccgtcagcatcatcagcagcatcagcgaggacctggagtgctactccagcacggcccccgtctccgaggtcagcatcacacagttcttgcccctcccgaagatgagcctggatgagaaggcccaggacgcagggagcagacgctcttccatcagctcctggctgagcgagatgagcgcgggcagtgagggtgagcagtcgtgccacagtttcatagcccagacgtgttttgggcacggggaggcaatggcagaacctgtggcctcggagtttgtcagcagcctccagaacaccgctgtggtgtgcagagagaagcccaaggccagccccgacaacttgctcatcctgtctgagatgggagatgactctttcaacaaagcagcccccatcaaaggctgcaaaatatccacagtgagcaaggccatggtcaccatctccaacacggccaatctgagcagctgcgaggggtacatccccatgaagaccaatatcacagtttacccctgcattgccatgagcccccggaacatccaagagccggaggcccccaccgccacccccaaagcaggccccacattagcccagtcccgggagagtaaggaaaacagtgcaaagaaagagatgaaatttgaggacccgtggctgaaacgagaagaggaagtgaaaaaagagacggctcatcccaatgaagaagggatgatgaggtgtgagactgccacgggcccctcgaatgctgagaccagagcagagcaggagcaggacggaaagcccagtccgggagacaggctcagcagcagcagcggagaggtgtcggcctccccggtcactgacaacttcaggagggtcgtggatgggtgtgagatggccctgcccggtttggccacccagagccccgtgcatcccaacaaaagcgtcaagtccagcagccttcccagggcctttcagaaggccagccggcaggaggagccggacagcctctcctattactgcgctgctgagaccaacggggtgggtgcagcctcgggcaccccgccctccaaggctaccctggaggggaaggtggcttcccccaagcactgtgttctggctcggcccaaagggactccccctctgccccctgtccgaaagtccagcctggaccagaagaaccgggccagccctcagcacagtgccagcggcagcggcaccagcagccccctgaaccaaccagccgccttcccggcgggcctcccagacgagcctagcggcaagacgaaggacgccagcagcagcagcaagctcttcagtgccaagctggagcagctggccagcagaagcaactcgctgggcagggcgacagtcagccactacgaatgcctctccctggagcgggccgagagcctgtcctccgtgagctcccggctgcacgcgggcaaggacggcaccatgccccgcgcggggaggagcctgggccgcagcgccgggacctcgccccccagctccggggcctcgcccaaggccggccagtccaagatctccgccgtgagcagactcctcctggccagccccagagcgcgcggcccgtccgcctccaccaccaaaaccctcagcttctccaccaagtccctgccgcaggcggtgggccagggctccagctcgccccccggtgggaagcacacgccctggtccacgcagtccctcagcaggaacaggagctcgggcctggcctccaagcttcccctgcgggccgtcagcgggcgcatctcggagctgctgcagggtggcgcgggcgcccggggcttgcagctgcgggccgggcccgaggcggaggcgcgcgggggggccctggccgaggacgagcccgcggccgcgcacctgctcccgtcgccctacagcaagatcacgcccccgcggaggccccaccgctgcagcagcggccacggcagcgacaacagcagcgtgctgagcggggagctcccgccggccatggggaagacggccctgttctaccacagcggcggcagcagcggctacgagagcgtgatgcgggacagcgaggccaccggcagcgcgtcctcggcgcaggactccacgagcgagaacagcagctccgtgggcggcaggtgccggagcctcaagaccccgaagaaacgctccaatccaggttctcagagacggaggcttatcccagcactatccctggacacctcttcccctgtgagaaaaccccccaacagcacaggcgtccgctgggtggatggccccttgcggagcagcccgaggggccttggggaaccctttgagattaaagtctatgaaatcgatgacgtggagcgcctgcagcggcgacgagggggtgccagcaaggaggccatgtgcttcaatgcaaagctgaagattctggaacaccgccagcagaggatcgccgaggtccgcgcgaagtacgagtggctgatgaaggagctggaggcgaccaaacagtatctgatgctggatcccaacaagtggctcagtgaatttgacttggagcaggtttgggagctggattccctggagtacctggaggcactggagtgtgtgacggagcgcctggagagccgtgtcaacttctgcaaggcccatctcatgatgatcacctgcttcgacatcacctccaggcgccggtagatgagccagacccttgtcctagtggtcccccgctccccaggacttcagagatgttgcacgcccctaggccctctgtgctggggcatcaaagacaatgaatgaggatgaaggttggtggcaagtctggagcgggcgttgagcggaaggcgagttttcttttgttttctgtaggaaaggtgcaaacgtcaaacaccgtggaaggagaaaaggatgggaagcccgaggggtgtccaagccctgtgagactgaaaaagcactttgaggaaccttaaagaccttgtttgtacataagaactgctagcaaaagagacctcactcttctcttgctttcgtgagaaaggaggggcgtggatgtaggattgctgtggaaagcgaacacaaaacaacccagaatgactgattaagtgccttgcaaatctttattattatccaaacatttatgttcatactttcttgtgtacagatggtgctagtcaagatgaaaacaacaaaacaaacaagaaaaacattttggaaatgtattcacagctctttttctcttggtgttttatcctatttctgacttgctgtttctaagtaagttgtgtttgtagagctatttcttaatcagtattgcttatgaataaatattacctgtcttttatggttattctggtgaggccactcaaacagagagacttccctcggcacgagccagtgtgtgtgtttccaaagtaggtttggagcagcaggtgacctcgatgccacatcccaacaagcagcgtggtcaggtagacccagaaggttgattgtggggcaggtgctttagagaacaggtgaggagacggcacctgcagcacaggggaggaggagtcctttgcgacctgggccctccctgctcctgggaggtgggccgtatgttctgtagaccgtttgcccccctcaagtcctccacacatgtggttccttgacccacaaatccacagtttgcgtggccctcaaaattcatattcatttttattccaaaaagtcttgaacgaaagctggaaccaattcaccagagccatatttctttctttagtattttctagtgttgtgttgtagattgattaaagtgggtttttccccagctgagagaccttctcaggcttgttcagagacttcaactgtattggattagaagaaggattcttgagactgtacatcttgtctgttgtccagagtacaaggatttcagctctcctgtgtcccaaagcctctatgccaagaagggacaggcttgtcctctcagtctttgctcctgcccaaaggcagagagagcttcccctccataactcacacgaccctggataggcagaacatagctgaagactatggatgtccaggtcttggctcccaacaactcaggacctcaaattcagatgttcctccctataacaattcccttaggaattatgatacccattttagtgattgatagaaacctggggtacagagtggtcaagggatttccctgataaaagctgtggtgctgatgatagtgcagcccagaatctaagagtccctgcagccttcgcatcgaggatggtacttaggcgtgtgcagagcacgcttcccttttgccctcaaatgcagcatatcttcatgagcctatttatttccaagctaggctgtctttattaaccaacaactcagccccagccactccccaagcggggaaaaaaacactacgtttcttggtcagtgtacctctggacactgcagcccacacagctggctgaactcggtaaatgggaaccgaagtcttgtgagcttcacatgacctgatcctttgttatcagaacagggttcaggtggccctgttggctcatgtgctttggaagccagctccctgggtcacgagtctggctttgcactttccataagagtctgcttctatgcaaaggtgcaaacaggagacatgcccaaatctgctggctgaacaggctaaactacagtgagaggctgctctggcatggctcgttcttccttctgtgtatctcccaagtctgacaagtgtgttgccctgggaagcaggacctccctgagctccttaaccttgaccccattctgcaggacagtcgcatgctctgggctcgcctctggcctcaaagcacttgtgtaagtgggcttgcttaacagtaatatccttggaggcttctggacccaaagggaagccaatccttcgagtttgccattgggctgctggttgctggtttcaaacatatagttcatgaaaagtctttaattggagattttcaaaggtgaatattctgtttttgttggaaagaaactcatctgatgagtcatcgatgagtttggctttcgcccctgccacatcctcccctgaggttccttccatgctgcactgccttcctttagccagtgacagagcctggtgcccttcctggactgaaaccgatggaatccttccgaggggagtggcattcggcttgcctcctgcctaaatctgcttttatccatttgtagcaactttatgctgtaacaaaaggcggaaggaaaccaagagttctcttagcaagtcagactccttcccaagatggcaatcacagaacacctcgcaggatctcgcaggccacggtgaaggagaatgctttatgttgatgttgtccattctctctctcttctctttgcttttttttgacctaaataagctgcaaacatgttaatttaccaatattgataaaccacatgaagaaatcaggcattttacgttatgatgtgcttgttcctgtctctgcctataaattgactgtattgatgatgaaggaaggagttccggctgaccattctgaagcagtcccagtcacgggaggatgccttacccagtggccagacatgatagttccaggtctccccttggttttggtgatagagaacccaaggaggcaagggggaatatcaacgaacccatttctatttcattacccacaagcgaaaggactagaaaaaaatatttgaaattaacatttagatgcataggtctaactccttgtgtgaacctgtcctcctcaccccctgctccaaatatgtgaggtggaagcattagcagcggagcaaaactaagatctaagaacgggcggtggtgctattgtgtccctgggagtcactccacgtcgcattgcacggtggtgctgaggagcgagagtttgctttatcatgggctttcagttcccacctgcgagctgcaaactttgatcttgttgtccttgaattcccctctacatcacgaggaagctgtctctttcatctcttccggatttggaatcagaacactctgcccgttgtttattcgccagttgccattcttaacatgggggagcattaagatgcaaatgcagagatgtgtcctgtcttgacaaaggtgggaacccctgagctggagaaggggctcctctcatgagaagctggggtaaacagccaggcatcgcagcgtggggaattagacaggcaggaatctggcctggtttgtcataaattagccttcaacttgaagtctattatgttcttataaggcggtagtgacttcagtccagccgcatctaccatccagggtggaggttcaaaaagtcttatacgcacctacaagtctcacgcttgctgctcagactttctgataaaatctcagagttctgtttgtattgaccaaaaatgcagttgtgcccacttgggtgtgtatctcatgtccttgtaaaccagccaccttctttggatagaaggcaaggctgacaaatctgcagatttgttcaatgcaaacacagccgtctatatcattggccactgctgattatattgagtgtttttaggttttttaggtttcttattccaaaaaggattttagactgtaaaatgactaaagatgagttaatttccaaactaaaaaaggaaggagtcctgcctgtactcattgttctttcctgctggactagtaacccattcttggagcacacacagagtccctcgcttctaaagacaatacgtcttaaaccctgaaaacttgccagtgagaaagaggttgaaagtcctgtttgctattagttgaggctaagccgtctgctgccactgtccctggggcctccatgctgccgccggggtatgtggcccagctgtccccccatgaaggacactcttcaatgccaccacacgggagtctgggcagggaggaaaggcacacagcccacttttctctgcaccaaatgaaacaaagctgggtgttcagtgtcactgatgcaagtaaatgggtctcaaattttggtgggggcagtgtttctttggattctgatacctctttttccacctccagaaagtatctgtcaacattggtgggtaacagcttataaagtgcatcacttagtaatcttcctgacaaaatgacacattttaaaattacaacctgttcattatttccatcataatgcaagcgtaattctaatccgggagaagatactgtcatttaagctcatcttctcaaaaaaattttttctgaaaattcctggaaactaatttatccctccctaaacaaacacattctgcttttgggtggccctacccagaacctgcagcaatgtcataacactggacacagtgcggcttggggcagtatcaagccttcattgcatacaaaccttaatctctaagcatagttgttcccaaggtccacacgtgtggaggcgagtactgaaataccacactcacacatctattccatgcgtacctagaaattaccttcaacactaaaaaaggttccttctttcattccctatcctgctaacagcccacattgtaatatttgatttatgaagaagttctaatttatttgtgaactcaggatgttgctttacagcattgctcgtgttctctcatttacttattatgcatcacggttggaaatgctatccacgtgccgtgcatcgaggtggagatttgctggatctgtctgtggctatttttttccatgtttttctcactcaagcaaagtctgttagtggaaacatgggctgggggatggggagaggacagataaagcaagagaatagggattagggtccaatcctcaatgcacagggcttagttcaaaatctaagctgtttctgtagtaagcagccaaatgggaaagatcccttcgttttgaatttgatgagaatgggcttggaaatccacgcccaccggcttgcacggaagaggactcagcctcttcctaatggttcaacattcaattcctgaggaaagtgctgatagtattagttccctacatttccctaagactcccatccaacccctagtgctactgaagagggtttgggaaagcaattggagttccttagcttggatatatatagtacctgtttttttcctctggaaaaaccaaagtactttagtgagtcttacaatcttaaggcattttgtcccctcactgggtcccgagaggcagggaggggctaggccttgagctaggagcaaggacatgggccgccaggcctggttgttactagctgtgcaaccttgggcgagcctcttcgctttgctgggcctcaggttcccgagtggaagactgggggtcagaacagctgcccttctgggagagcatcaagagaaagtggtataagtgatgggaagtgctttgaagaaattaaaggtctgtctaggagctgggggtaatcatttacagatgaagaaactgaagtctagtcattgactggcccgagttcacagagtggttttatagcaaaacagggacttgagtccagcttattggattcttcccatcagatcatattgcaccaggtatgtgtagacatgaacacataccattcctctaaggtgtgtgtacatacacggatgtgtgtgtacaggaggtacctgacatggtgaaaggccataggacagaaaacctgagttctaattccagctttgccagtcgtcccgtccgtgatatattccataggacagaaaacctgagttctaattccagctttgccagtcatcctgtccgtgatatattccataggacagaaaacctgagttctaattccagctttgccagtcgtcccgtccgtgatatattacctaactcctccagaactcagttttctaacctataaaatgaagacattgtgctagatgatctttgtggttccttcaagctctggatctctaattccatgattagtaatgtatgtatgtgtatataaatatgcttatctgtagaaatgggcccatttgaaaagtggagacaaggtctgcccaggtgcatttattgtgccagaaacagtgaattcctaaataagttcataaaatcttgttttacaattcaatggtagtgcttaatgttactgtctgaaatccactgtttaaccagatggaagactggggccattcaaaacattattagttcacaagtgtttgctgttaaaatgcttcaataaaactcatttgttaaagtcagaaattcaactcttctgtacttgggcaggtcccagcagccccttggcaggctagttttgtgcatgggcctttgcaagctatataaacgttaggtgttggcttgattatgataaatatgagcaggctccctggagaacagtccagaaaaaaagagttatagttctcacaaactggtgacatgaatccattaagctgtgtggcattttccagtgtaaagacattgtttgctggctacgatctctgactttttgtggcatatgaggtgtaaaatgttgtcaaaaaagaatctggtgtttaaaaaaaaatcaaactatggtggcattaaatgttcacttttattcta

SEQ ID NO: 214 - DNA, 1389 bp, Homo sapiens
ggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaa

SEQ ID NO: 215 - DNA, 2476 bp, Homo sapiens
gggaagggaatgtgaccaggtctaggtctggagtttcagcttggacactgagccaagcagacaagcaaagcaagccaggacacaccatcctgccccaggcccagcttctctcctgccttccaacgccatggggagcaatctcagcccccaactctgcctgatgccctttatcttgggcctcttgtctggaggtgtgaccaccactccatggtctttggcccggccccagggatcctgctctctggagggggtagagatcaaaggcggctccttccgacttctccaagagggccaggcactggagtacgtgtgtccttctggcttctacccgtaccctgtgcagacacgtacctgcagatctacggggtcctggagcaccctgaagactcaagaccaaaagactgtcaggaaggcagagtgcagagcaatccactgtccaagaccacacgacttcgagaacggggaatactggccccggtctccctactacaatgtgagtgatgagatctctttccactgctatgacggttacactctccggggctctgccaatcgcacctgccaagtgaatggccgatggagtgggcagacagcgatctgtgacaacggagcggggtactgctccaacccgggcatccccattggcacaaggaaggtgggcagccagtaccgccttgaagacagcgtcacctaccactgcagccgggggcttaccctgcgtggctcccagcggcgaacgtgtcaggaaggtggctcttggagcgggacggagccttcctgccaagactccttcatgtacgacacccctcaagaggtggccgaagctttcctgtcttccctgacagagaccatagaaggagtcgatgctgaggatgggcacggcccaggggaacaacagaagcggaagatcgtcctggacccttcaggctccatgaacatctacctggtgctagatggatcagacagcattggggccagcaacttcacaggagccaaaaagtgtctagtcaacttaattgagaaggtggcaagttatggtgtgaagccaagatatggtctagtgacatatgccacataccccaaaatttgggtcaaagtgtctgaagcagacagcagtaatgcagactgggtcacgaagcagctcaatgaaatcaattatgaagaccacaagttgaagtcagggactaacaccaagaaggccctccaggcagtgtacagcatgatgagctggccagatgacgtccctcctgaaggctggaaccgcacccgccatgtcatcatcctcatgactgatggattgcacaacatgggcggggacccaattactgtcattgatgagatccgggacttgctatacattggcaaggatcgcaaaaacccaagggaggattatctggatgtctatgtgtttggggtcgggcctttggtgaaccaagtgaacatcaatgctttggcttccaagaaagacaatgagcaacatgtgttcaaagtcaaggatatggaaaacctggaagatgttttctaccaaatgatcgatgaaagccagtctctgagtctctgtggcatggtttgggaacacaggaagggtaccgattaccacaagcaaccatggcaggccaagatctcagtcattcgcccttcaaagggacacgagagctgtatgggggctgtggtgtctgagtactttgtgctgacagcagcacattgtttcactgtggatgacaaggaacactcaatcaaggtcagcgtaggaggggagaagcgggacctggagatagaagtagtcctatttcaccccaactacaacattaatgggaaaaaagaagcaggaattcctgaattttatgactatgacgttgccctgatcaagctcaagaataagctgaaatatggccagactatcaggcccatttgtctcccctgcaccgagggaacaactcgagctttgaggcttcctccaactaccacttgccagcaacaaaaggaagagctgctccctgcacaggatatcaaagctctgtttgtgtctgaggaggagaaaaagctgactcggaaggaggtctacatcaagaatggggataagaaaggcagctgtgagagagatgctcaatatgccccaggctatgacaaagtcaaggacatctcagaggtggtcacccctcggttcctttgtactggaggagtgagtccctatgctgaccccaatacttgcagaggtgattctggcggccccttgatagttcacaagagaagtcgtttcattcaagttggtgtaatcagctggggagtagtggatgtctgcaaaaaccagaagcggcaaaagcaggtacctgctcacgcccgagactttcacatcaacctctttcaagtgctgccctggctgaaggagaaactccaagatgaggatttgggttttctataaggggtttcctgctggacaggggcgtgggattgaattaaaacagctgcgacaaca

SEQ ID NO: 216 - DNA, 3895 bp, Homo sapiens
gcccctggccaccaagcgcctccgtggacacgcacttcctgcgagggctccgtgcgcaccttggccgagccgaaccgagccgagtcctgtccttccaggccgttcgcaatggtggatgagttggtgctgctgctgcacgcgctcctgatgcggcaccgcgccctgagcatcgagaacagccagctcatggaacagctgcggctgctggtgtgcgagagggccagcctgctgcgccaggtacgtccgccgagctgcccggtgcccttccccgaaacgtttaatggcgagagctcccggctccccgagtttatcgtgcagacggcgtcttacatgctcgtgaacgagaaccgattctgcaacgacgccatgaaggtggcattcctaatcagcctcctcaccggggaagccgaggagtgggtggtgccctacatcgagatggatagccccatcctaggtgattaccgggccttcctcgatgagatgaaacagtgctttggctgggatgacgacgaagacgacgacgacgaagaagaggaggatgattattaggccctcgaccctcgggcctcgggggggagggccctgcacgccgccaccccctccccgcagccctcaccccgccaggagccactgctctcccccttgccctccggtccccttacctacccgcgcccgtctgctctctctcttcatttctccgtagtgcttgtctttgttccaggaatagcgctccagttacctgctgctggggtcggggctggagcctcactcactcggaagtgcttggaagtgtcatctaccctggccatccccgggatccctcccctgctaatctgaactgtgtcctgaaccccagctattggccaggcccctgttacaaactgcgcagaccacccgtagccctgctgctgccacctgccctgctgccaggcttacatcttcccagagaactatgctgccacttcacatccactcaccacatcccacctacagactaccacctttcgagatcaggaccaacctggaaaatgccagagttggctatgccttttcagacattgatttggacagctcaccaacccctgaaggggccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggcattattttcaataaatatcaagcactaaaaaaagaaatgattgtcttttaatggttaagtgctatcactggcctctaccactgtcactctgactaccattattcccgtggaaatcagggaatacaaccaatcctagtattccccgctgtcatctccaggctgctggggacagctacctcagggctttgtcagggttctgatgctcccttcaccaacgcatttcttaaagccctggcaaagggtgtgttctctgggtcctccagggtggcgtggttaagggttggctgagcagacggcaaagagagcagtattaataattagaccataacaataggcgtaaacctggacatatatatgtaatgctcctaattctctgagcttttggattccttaacactgtgccagggaagttctgccccttaatccttattgcctatgtgcagctgttgagttcagactccagagagccaacatagtagattgtcactttcaaactccaaatagccaacatgtcactttcaggtgctccagctaacattaagtcccggatcctgggcaagtgcacccataaagatatagcctgatcttaacaaacatttcgttctccttggacagacatccttagaattcccactcatagatgtgtcccagattcctccctatggaaattagcaagatgcttggttatctcttaaatcagaccttgtactgctatctaggggctatgctgagatctctgggcctggagggttcagagcagtgaagggggtggctgctgagaagaagctgcatacctgtgtgaggccattgctccaggttaagtcattgaaatgtttaatgcagagcagcttggttggggatttgagaggactgcctcttagaaaggtttaggaggatatgaggggttcagagttctcttttatatctgtccagatgtcctcattgtaccatgtctggagccaacttgactttataacctttaattaatttagataacacatttccgtactgtttaaggccttttgaggcaagatattgtatttgtactggtaaacctcagtgttgattaaatgagatatgggtcttcatattaatcacctcataggtgcggattaaatgagatcatacccatgaagcatttagaactttccctgctacatggtgagcactcagcaaaccatgggctgttactcctgggccagggaacagaagtctcagaaagcaagtctctgactctgagcctggctttagtaggaaaatgtcagcgtgaagaggagcagagcaggttcagggagaatggaaatgagagcatgataagaccccatttactttttggagtcttatatgaagcaagaaacaaagctgttttacgtggtggacaggcaaagttcagggtaggagttatatctcacccctaggatagctgtttctggagggtggggacagggttgcgtatgacttaataaaagaggctgaggcttgggtggaaatgagatctggggctcttcagggagctgccgcctccaaatctgaatcaaggagacagctggttatttagaattcattgatcacttctcccagtctccttggaaaatatacaaaaccccttggaagagagagattatatttgagacataatatgtgtgaggccagataattacactttcttcctaactagaaaggccttgaattggggataaatgtggaaaagtgagcaagatctaaaaggtaaaggatccagtgagaccaaaagtcatttattccaaactgattatggcccagttatgctgagtggagttacagaaacatctttgaataaaatgtgatctctgccttcatagcgagtccagtctgctgcttttactgtgccctgggtcagaactttgatgattagttacaggaaagggccaggaagagaatctgggctgtgattagatctgggaatgacctttctggggtggaagttgaggacatatgagtaggtgttctgtggaggaagggaggttcagtaaggatgccatgccaaggcagcatctgaatggcatctgggagaactaggccagggagcttctgtgatctgaagtgtacatttcctgagtatgtgtgcatgtgcacatgagcttgctgtgacccagtatgtgtgtgctctgtgtgtgtgtgtgttaagtgatgtccttcttacatcatggacaaacaggttatgctgtgagatgcagaaaagggattctggttactttgggggcagattctgcaataaaagcgcagatactggcaagggctccaccacccagggaggaattcatgataatggcataaagcatggcaaaaaagaaggaagaagtagaagtatgtctaaggataaaagtgccactttgatcaaaactattaaaaataggtaggaatgctgaataaatatgaacttagaccctgaattctcattttgggcgtaatagacttgaaatggccgctgaaattatactatcaatgaaatgaaattagtcatattaaatgtcgtaatcatttaatcgtattaaatataccaatata

SEQ ID NO: 217 - DNA, 3288 bp, Homo sapiens
cgagtcttctcatcccgggacgcaaacctcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccctaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgctaaaaaaa

SEQ ID NO: 218 - DNA, 1274 bp, Homo sapiens
agcccagtcgccgccgcccgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgctggccgtgctgggctggctgggcaccatcgtgtgctgcgcgttgcccatgtggcgcgtgtcggccttcatcggcagcaacatcatcacgtcgcagaacatctgggagggcctgtggatgaactgcgtggtgcagagcaccggccagatgcagtgcaaggtgtacgactcgctgctggcactgccacaggaccttcaggcggcccgcgccctcatcgtggtggccatcctgctggccgccttcgggctgctagtggcgctggtgggcgcccagtgcaccaactgcgtgcaggacgacacggccaaggccaagatcaccatcgtggcaggcgtgctgttccttctcgccgccctgctcaccctcgtgccggtgtcctggtcggccaacaccattatccgggacttctacaaccccgtggtgcccgaggcgcagaagcgcgagatgggcgcgggcctgtacgtgggctgggcggccgcggcgctgcagctgctggggggcgcgctgctctgctgctcgtgtcccccacgcgagaagaagtacacggccaccaaggtcgtctactccgcgccgcgctccaccggcccgggagccagcctgggcacaggctacgaccgcaaggactacgtctaagggacagacgcagggagaccccaccaccaccaccaccaccaacaccaccaccaccaccgcgagctggagcgcgcaccaggccatccagcgtgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccggcagccctggaaggggcacttgatatttttcaataaaagcctttcgttttgca

SEQ ID NO: 219 - DNA, 2625 bp, Homo sapiens
gccttctgcccgggcgctcgcagccgagcgcggccggggaagggctctcctcccagcgccgagcactgggccctggcagacgccccaagattgttgtgaggagtctagccagttggtgagcgctgtaatctgaaccagctgtgtccagactgaggccccatttgcattgtttaacatacttagaaaatgaagtgttcatttttaacattcctcctccaattggtttaatgctgaattactgaagagggctaagcaaaaccaggtgcttgcgctgagggctctgcagtggctgggaggaccccggcgctctccccgtgtcctctccacgactcgctcggcccctctggaataaaacacccgcgagccccgagggcccagaggaggccgacgtgcccgagctcctccgggggtcccgcccgcgagctttcttctcgccttcgcatctcctcctcgcgcgtcttggacatgccaggaataaaaaggatactcactgttaccattctggctctctgtcttccaagccctgggaatgcacaggcacagtgcacgaatggctttgacctggatcgccagtcaggacagtgtttagatattgatgaatgccgaaccatccccgaggcctgccgaggagacatgatgtgtgttaaccaaaatggcgggtatttatgcattccccggacaaaccctgtgtatcgagggccctactcgaacccctactcgaccccctactcaggtccgtacccagcagctgccccaccactctcagctccaaactatcccacgatctccaggcctcttatatgccgctttggataccagatggatgaaagcaaccaatgtgtggatgtggacgagtgtgcaacagattcccaccagtgcaaccccacccagatctgcatcaatactgaaggcgggtacacctgctcctgcaccgacggatattggcttctggaaggccagtgcttagacattgatgaatgtcgctatggttactgccagcagctctgtgcgaatgttcctggatcctattcttgtacatgcaaccctggttttaccctcaatgaggatggaaggtcttgccaagatgtgaacgagtgtgccaccgagaacccctgcgtgcaaacctgcgtcaacacctacggctctttcatctgccgctgtgacccaggatatgaacttgaggaagatggcgttcattgcagtgatatggacgagtgcagcttctctgagttcctctgccaacatgagtgtgtgaaccagcccggcacatacttctgctcctgccctccaggctacatcctgctggatgacaaccgaagctgccaagacatcaacgaatgtgagcacaggaaccacacgtgcaacctgcagcagacgtgctacaatttacaagggggcttcaaatgcattgaccccatccgctgtgaggagccttatctgaggatcagtgataaccgctgtatgtgtcctgctgagaaccctggctgcagagaccagccctttaccatcttgtaccgggacatggacgtggtgtcaggacgctccgttcccgctgacatcttccaaatgcaagccacgacccgctaccctggggcctattacattttccagatcaaatctgggaatgagggcagagaattttacatgcggcaaacgggccccatcagtgccaccctggtgatgacacgccccatcaaagggccccgggaaatccagctggacttggaaatgatcactgtcaacactgtcatcaacttcagaggcagctccgtgatccgactgcggatatatgtgtcgcagtacccattctgagcctcgggctggagcctccgacgctgcctctcattggcaccaagggacaggagaagagaggaaataacagagagaatgagagcgacacagacgttaggcatttcctgctgaacgtttccccgaagagtcagccccgacttcctgactctcacctgtactattgcagacctgtcaccctgcaggacttgccacccccagttcctatgacacagttatcaaaaagtattatcattgctcccctgatagaagattgttggtgaattttcaaggccttcagtttatttccactattttcaaagaaaatagattaggtttgcgggggtctgagtctatgttcaaagactgtgaacagcttgctgtcacttcttcacctcttccactccttctctcactgtgttactgctttgcaaagacccgggagctggcggggaaccctgggagtagctagtttgctttttgcgtacacagagaaggctatgtaaacaaaccacagcaggatcgaagggtttttagagaatgtgtttcaaaaccatgcctggtattttcaaccataaaagaagtttcagttgtccttaaatttgtataacggtttaattctgtcttgttcattttgagtatttttaaaaaatatgtcgtagaattccttcgaaaggccttcagacacatgctatgttctgtcttcccaaacccagtctcctctccattttagcccagtgttttctttgaggaccccttaatcttgctttctttagaatttttacccaattggattggaatgcagaggtctccaaactgattaaatatttgaagaga

SEQ ID NO: 220 - DNA, 8009 bp, Homo sapiens
cctcttatctgatcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctggaaccttgcccagcacaggtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacacaatcacttcctacacgaccaccaacttttcctccaaccattccaccagcaaaagaagtatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagctccccatccagatcagccagagttcacccctgtccaagatgagctggaagccatggaactgtggggccctggagtctgatagcctcaggagaaatttgaagaccaactgcaagaactcttaaggaatcttgtttgagaaaatgttgttatgtggtttgtatgctacttttggggggcagggctcatttcagcagcctaaatctcctccttggataatgttaatattattattattattaacaaaaaatatatatttttaaaaagttcccttaatctatgacatggtagcaatgatttccctttggtgtcttaatggcatgtcagataatttgtttttccagagaagagagctcaaagaggaattgggaaaaataaattgaactctggaatcttctctctcaagtcctaaaatgaacaaacagatatgattgtgtttgagggaaatatgtccctagcaggaaaagaattcaaagaggttcaaagaatatgtcacttactcctacttgctgtaggaataaccttgctgataagaaaaaaagggacaatattggagaaactacctcttgtttaattgatctgtccaactctgagatcacttggtaactggtttcatgtgtatccaaaaatcagcatttggatttaagctttctgaatttggtagtttaagaaacagatttagtttttcagtggttttaactcatgtgaaataatgattttccaccagctctgatgcaaagagatataattttaatgaacgatttatccagcagtgtgttccaggggttgcctctccttatctacggggattactttgtacatgcagataagttttcgcaaacctatttccattttcttttgtaagcaaataaaactttaaaacaatgtatgtggattctttttcctgcatttctaagtatcaccttaagcttttgtagtcttaactgagtgtccaccagaaagacaacagttgtcttcctttaggtaagcattcaaactttcattcattcgtttactcactcactcattcattcattctgagtgcagtagaaaacagaagaagcagttaacttgggactaagagattagcgacattttattgttcatttataatctagcaggcagcaaagaccctgcaaatgcatgacctctgctaaataaatgtttatcaatagttgactgaggagcccacctatcttctgatattgaggaaagcctaaaaacccctagaaggcagagcagaaatgaggttgaatctaatagactctaacccttaaaccatactttgtcttttgctcacaaaggaaaaatctaggtatttgagaaagatttgaattctattatgtgctagttgaaatagaaacaaaagagaaccataaatttaatacgtgctccttctctgtaacatctccctagtaacagctaactttagaaagtagggatgggatcatttacaactagaagctggattctttctggatcaggaaaaggctaacacgaaggatggtgtctgtctgatcaccaggttctctttctgtccttctcataatctcctgatctttggagatgaaagatctcctttcatcttcatctgaaggattcttcagatgattcatcttcagacttcatctgaaggattcaaacaatctacttgtgtgcctttggtggggtggggcaggggcggggggcggttctaaacaaatcagtttttttggtgtctttgcagggaatgaaagaagataatgagcagataatcagcagccatttcctttcagttatggtatatgattctgcctgagaaagcaggatttatgggaaggaaaacttgtctaaggctcatcaagatggcctgacccagagtcacctaagagaactcttccaacttaaatgactagggtgtgtaatcagttgcttcttattctgtgtctcagatttcctagtccatgacatttaatagtgagtatagagtaggatattctatacattttagtatttggcccttggaaacaaagttaaataccatgtcactcagaagactctcaaagtttgtgtataaatggcgaagtatacactatgagagattctaatccattcacatcattcttgagttgtgcaaatacacttggctttgatttcacttggtgatctaaatttgtttatttaagctgcaagaaagttacattaatttggaatgtgtcatcacttggacccagtatatcagatttttattgagtaaaatgttaaaaataataagtgtaactcagattctggatgttcgagtttacaatacattgcctgtaataaaagctgattctgaagtgcatttttcttgacttactttggcagaaatatacttatatcttaatttatagtttgtaagtttatactgttttctaaaagtaataaatcatttcatgaaaaata

SEQ ID NO: 221 - DNA, 5701 bp, Homo sapiens
ggccacgtccaccggagcatcctgcactgcagggccggtctctcgctccagcagagcctgcgcctttctgactcggtccggaacactgaaaccagtcatcactgcatctttttggcaaaccaggagctcagctgcaggaggcaggatggtctggaggctggtcctgctggctctgtgggtgtggcccagcacgcaagctggtcaccaggacaaagacacgaccttcgaccttttcagtatcagcaacatcaaccgcaagaccattggcgccaagcagttccgcgggcccgaccccggcgtgccggcttaccgcttcgtgcgctttgactacatcccaccggtgaacgcagatgacctcagcaagatcaccaagatcatgcggcagaaggagggcttcttcctcacggcccagctcaagcaggacggcaagtccaggggcacgctgttggctctggagggccccggtctctcccagaggcagttcgagatcgtctccaacggccccgcggacacgctggatctcacctactggattgacggcacccggcatgtggtctccctggaggacgtcggcctggctgactcgcagtggaagaacgtcaccgtgcaggtggctggcgagacctacagcttgcacgtgggctgcgacctcatagacagcttcgctctggacgagcccttctacgagcacctgcaggcggaaaagagccggatgtacgtggccaaaggctctgccagagagagtcacttcaggggtttgcttcagaacgtccacctagtgtttgaaaactctgtggaagatattctaagcaagaagggttgccagcaaggccagggagctgagatcaacgccatcagtgagaacacagagacgctgcgcctgggtccgcatgtcaccaccgagtacgtgggccccagctcggagaggaggcccgaggtgtgcgaacgctcgtgcgaggagctgggaaacatggtccaggagctctcggggctccacgtcctcgtgaaccagctcagcgagaacctcaagagagtgtcgaatgataaccagtttctctgggagctcattggtggccctcctaagacaaggaacatgtcagcttgctggcaggatggccggttctttgcggaaaatgaaacgtgggtggtggacagctgcaccacgtgtacctgcaagaaatttaaaaccatttgccaccaaatcacctgcccgcctgcaacctgcgccagtccatcctttgtggaaggcgaatgctgcccttcctgcctccactcggtggacggtgaggagggctggtctccgtgggcagagtggacccagtgctccgtgacgtgtggctctgggacccagcagagaggccggtcctgtgacgtcaccagcaacacctgcttggggccctccatccagacacgggcttgcagtctgagcaagtgtgacacccgcatccggcaggacggcggctggagccactggtcaccttggtcttcatgctctgtgacctgtggagttggcaatatcacacgcatccgtctctgcaactccccagtgccccagatggggggcaagaattgcaaagggagtggccgggagaccaaagcctgccagggcgccccatgcccaatcgatggccgctggagcccctggtccccgtggtcggcctgcactgtcacctgtgccggtgggatccgggagcgcacccgggtctgcaacagccctgagcctcagtacggagggaaggcctgcgtgggggatgtgcaggagcgtcagatgtgcaacaagaggagctgccccgtggatggctgtttatccaacccctgcttcccgggagcccagtgcagcagcttccccgatgggtcctggtcatgcggctcctgccctgtgggcttcttgggcaatggcacccactgtgaggacctggacgagtgtgccctggtccccgacatctgcttctccaccagcaaggtgcctcgctgtgtcaacactcagcctggcttccactgcctgccctgcccgccccgatacagagggaaccagcccgtcggggtcggcctggaagcagccaagacggaaaagcaagtgtgtgagcccgaaaacccatgcaaggacaagacacacaactgccacaagcacgcggagtgcatctacctgggccacttcagcgaccccatgtacaagtgcgagtgccagacaggctacgcgggcgacgggctcatctgcggggaggactcggacctggacggctggcccaacctcaatctggtctgcgccaccaacgccacctaccactgcatcaaggataactgcccccatctgccaaattctgggcaggaagactttgacaaggacgggattggcgatgcctgtgatgatgacgatgacaatgacggtgtgaccgatgagaaggacaactgccagctcctcttcaatccccgccaggctgactatgacaaggatgaggttggggaccgctgtgacaactgcccttacgtgcacaaccctgcccagatcgacacagacaacaatggagagggtgacgcctgctccgtggacattgatggggacgatgtcttcaatgaacgagacaattgtccctacgtctacaacactgaccagagggacacggatggtgacggtgtgggggatcactgtgacaactgccccctggtgcacaaccctgaccagaccgacgtggacaatgaccttgttggggaccagtgtgacaacaacgaggacatagatgacgacggccaccagaacaaccaggacaactgcccctacatctccaacgccaaccaggctgaccatgacagagacggccagggcgacgcctgtgaccctgatgatgacaacgatggcgtccccgatgacagggacaactgccggcttgtgttcaacccagaccaggaggacttggacggtgatggacggggtgatatttgtaaagatgattttgacaatgacaacatcccagatattgatgatgtgtgtcctgaaaacaatgccatcagtgagacagacttcaggaacttccagatggtccccttggatcccaaagggaccacccaaattgatcccaactgggtcattcgccatcaaggcaaggagctggttcagacagccaactcggaccccggcatcgctgtaggttttgacgagtttgggtctgtggacttcagtggcacattctacgtaaacactgaccgggacgacgactatgccggcttcgtctttggttaccagtcaagcagccgcttctatgtggtgatgtggaagcaggtgacgcagacctactgggaggaccagcccacgcgggcctatggctactccggcgtgtccctcaaggtggtgaactccaccacggggacgggcgagcacctgaggaacgcgctgtggcacacggggaacacgccggggcaggtgcgaaccttatggcacgaccccaggaacattggctggaaggactacacggcctataggtggcacctgactcacaggcccaagactggctacatcagagtcttagtgcatgaaggaaaacaggtcatggcagactcaggacctatctatgaccaaacctacgctggcgggcggctgggtctatttgtcttctctcaagaaatggtctatttctcagacctcaagtacgaatgcagagatatttaaacaagatttgctgcatttccggcaatgccctgtgcatgccatggtccctagacacctcagttcattgtggtccttgtggcttctctctctagcagcacctcctgtcccttgaccttaactctgatggttcttcacctcctgccagcaaccccaaacccaagtgccttcagaggataaatatcaatggaactcagagatgaacatctaacccactagaggaaaccagtttggtgatatatgagactttatgtggagtgaaaattgggcatgccattacattgctttttcttgtttgtttaaaaagaatgacgtttacatataaaatgtaattacttattgtatttatgtgtatatggagttgaagggaatactgtgcataagccattatgataaattaagcatgaaaaatattgctgaactacttttggtgcttaaagttgtcactattcttgaattagagttgctctacaatgacacacaaatcccattaaataaattataaacaagggtcaattcaaatttgaagtaatgttttagtaaggagagattagaagacaacaggcatagcaaatgacataagctaccgattaactaatcggaacatgtaaaacagttacaaaaataaacgaactctcctcttgtcctacaatgaaagccctcatgtgcagtagagatgcagtttcatcaaagaacaaacatccttgcaaatgggtgtgacgcggttccagatgtggatttggcaaaacctcatttaagtaaaaggttagcagagcaaagtgcggtgctttagctgctgcttgtgccgctgtggcgtcggggaggctcctgcctgagcttccttccccagctttgctgcctgagaggaaccagagcagacgcacaggccggaaaaggcgcatctaacgcgtatctaggctttggtaactgcggacaagttgcttttacctgatttgatgatacatttcattaaggttccagttataaatattttgttaatatttattaagtgactatagaatgcaactccatttaccagtaacttattttaaatatgcctagtaacacatatgtagtataatttctagaaacaaacatctaataagtatataatcctgtgaaaatatgaggcttgataatattaggttgtcacgatgaagcatgctagaagctgtaacagaatacatagagaataatgaggagtttatgatggaaccttaaatatataatgttgccagcgattttagttcaatatttgttactgttatctatctgctgtatatggaattcttttaattcaaacgctgaaaagaatcagcatttagtcttgccaggcacacccaataatcagtcatgtgtaatatgcacaagtttgtttttgtttttgttttttttgttggttggtttgtttttttgctttaagttgcatgatctttctgcaggaaatagtcactcatcccactccacataaggggtttagtaagagaagtctgtctgtctgatgatggatagggggcaaatctttttcccctttctgttaatagtcatcacatttctatgccaaacaggaacaatccataactttagtcttaatgtacacattgcattttgataaaattaattttgttgtttcctttgaggttgatcgttgtgttgttgttttgctgcactttttacttttttgcgtgtggagctgtattcccgagaccaacgaagcgttgggatacttcattaaatgtagcgactgtcaacagcgtgcaggttttctgtttctgtgttgtggggtcaaccgtacaatggtgtgggagtgacgatgatgtgagtatttagaatgtaccatattttttgtaaattatttatgtttttctaaacaaatttatcgtataggttgatgaaacgtcatgtgttttgccaaagactgtaaatatttatttatgtgttcacatggtcaaaatttcaccactgaaaccctgcacttagctagaacctcatttttaaagattaacaacaggaaataaattgtaaaaaaggttttctata

SEQ ID NO: 222 - DNA, 2582 bp, Homo sapiens
agtagtgcagcccgtggagccgcggctttgcccgtctcctctgggtggccccagtgcgcgggctgacactcattcagccggggaaggtgaggcgagtagaggctggtgcggaacttgccgcccccagcagcgccggcgggctaagcccagggccgggcagacaaaagaggccgcccgcgtaggaaggcacggccggcggcggcggagcgcagcgatggccgggcgagggggcagcgcgctgctggctctgtgcggggcactggctgcctgcgggtggctcctgggcgccgaagcccaggagcccggggcgcccgcggcgggcatgaggcggcgccggcggctgcagcaagaggacggcatctccttcgagtaccaccgctaccccgagctgcgcgaggcgctcgtgtccgtgtggctgcagtgcaccgccatcagcaggatttacacggtggggcgcagcttcgagggccgggagctcctggtcatcgagctgtccgacaaccctggcgtccatgagcctggtgagcctgaatttaaatacattgggaatatgcatgggaatgaggctgttggacgagaactgctcattttcttggcccagtacctatgcaacgaataccagaaggggaacgagacaattgtcaacctgatccacagtacccgcattcacatcatgccttccctgaacccagatggctttgagaaggcagcgtctcagcctggtgaactcaaggactggtttgtgggtcgaagcaatgcccagggaatagatctgaaccggaactttccagacctggataggatagtgtacgtgaatgagaaagaaggtggtccaaataatcatctgttgaaaaatatgaagaaaattgtggatcaaaacacaaagcttgctcctgagaccaaggctgtcattcattggattatggatattccttttgtgctttctgccaatctccatggaggagaccttgtggccaattatccatatgatgagacgcggagtggtagtgctcacgaatacagctcctccccagatgacgccattttccaaagcttggcccgggcatactcttctttcaacccggccatgtctgaccccaatcggccaccatgtcgcaagaatgatgatgacagcagctttgtagatggaaccaccaacggtggtgcttggtacagcgtacctggagggatgcaagacttcaattaccttagcagcaactgttttgagatcaccgtggagcttagctgtgagaagttcccacctgaagagactctgaagacctactgggaggataacaaaaactccctcattagctaccttgagcagatacaccgaggagttaaaggatttgtccgagaccttcaaggtaacccaattgcgaatgccaccatctccgtggaaggaatagaccacgatgttacatccgcaaaggatggtgattactggagattgcttatacctggaaactataaacttacagcctcagctccaggctatctggcaataacaaagaaagtggcagttccttacagccctgctgctggggttgattttgaactggagtcattttctgaaaggaaagaagaggagaaggaagaattgatggaatggtggaaaatgatgtcagaaactttaaatttttaaaaaggcttctagttagctgctttaaatctatctatataatgtagtatgatgtaatgtggtcttttttttagattttgtgcagttaatacttaacattgatttattttttaatcatttaaatattaatcaactttccttaaaataaatagcctcttaggtaaaaatataagaacttgatatatttcattctcttatatagtattcattttcctacctatattacacaaaaaagtatagaaaagatttaagtaattttgccatcctaggcttaaatgcaatattcctggtattatttacaatgcagaattttttgagtaattctagctttcaaaaattagtgaagttcttttactgtaattggtgacaatgtcacataatgaatgctattgaaaaggttaacagatacagctcggagttgtgagcactctactgcaagacttaaatagttcagtataaattgtcgtttttttcttgtgctgactaactataagcatgatcttgttaatgcatttttgatgggaagaaaaggtacatgtttacaaagaggttttatgaaaagaataaaaattgacttcttgcttgtacatataggagcaatactattatattatgtagtccgttaacactacttaaaagtttagggttttctcttggttgtagagtggcccagaattgcattctgaatgaataaaggttaaaaaaaaatccccagtgcatgtatttcagttctctaagatttttggtctggcattgtggtcttatgatgaaaacatgtatcctcttaatggcggcttctcatatattcatcctgtacattttaaaatttgttaagcaactactgtgtgctaagcactgcatagcctctatgtatgttattgtggcaggcaaaaggttctgattttgggcacaacctttatataaataacacaaaaattaa

SEQ ID NO: 223 - DNA, 2673 bp, Homo sapiens
agagaggaaagtgacagaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggagtcggctgaatgcccacggtgcgcccggggcccctgagcccatcccgctcctagccgctgccctaaggcccccgcgcgccccgcgccccccacccggggccgcgccgcctccgtccgcccctcccccggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaa

SEQ ID NO: 224 - DNA, 4556 bp, Homo sapiens
acgcagctgcgggcggcgggcggcgcgcacactgctcgctgggccgcggctcccgggtgtcccaggcccggccggtgcgcagagcatggcgggtgcgggcccgaagcggcgcgcgctagcggcgccggcggccgaggagaaggaagaggcgcgggagaagatgctggccgccaagagcgcggacggctcggcgccggcaggcgagggcgagggcgtgaccctgcagcggaacatcacgctgctcaacggcgtggccatcatcgtggggaccattatcggctcgggcatcttcgtgacgcccacgggcgtgctcaaggaggcaggctcgccggggctggcgctggtggtgtgggccgcgtgcggcgtcttctccatcgtgggcgcgctctgctacgcggagctcggcaccaccatctccaaatcgggcggcgactacgcctacatgctggaggtctacggctcgctgcccgccttcctcaagctctggatcgagctgctcatcatccggccttcatcgcagtacatcgtggccctggtcttcgccacctacctgctcaagccgctcttccccacctgcccggtgcccgaggaggcagccaagctcgtggcctgcctctgcgtgctgctgctcacggccgtgaactgctacagcgtgaaggccgccacccgggtccaggatgcctttgccgccgccaagctcctggccctggccctgatcatcctgctgggcttcgtccagatcgggaagggtgatgtgtccaatctagatcccaacttctcatttgaaggcaccaaactggatgtggggaacattgtgctggcattatacagcggcctctttgcctatggaggatggaattacttgaatttcgtcacagaggaaatgatcaacccctacagaaacctgcccctggccatcatcatctccctgcccatcgtgacgctggtgtacgtgctgaccaacctggcctacttcaccaccctgtccaccgagcagatgctgtcgtccgaggccgtggccgtggacttcgggaactatcacctgggcgtcatgtcctggatcatccccgtcttcgtgggcctgtcctgcttcggctccgtcaatgggtccctgttcacatcctccaggctcttcttcgtggggtcccgggaaggccacctgccctccatcctctccatgatccacccacagctcctcacccccgtgccgtccctcgtgttcacgtgtgtgatgacgctgctctacgccttctccaaggacatcttctccgtcatcaacttcttcagcttcttcaactggctctgcgtggccctggccatcatcggcatgatctggctgcgccacagaaagcctgagcttgagcggcccatcaaggtgaacctggccctgcctgtgttcttcatcctggcctgcctcttcctgatcgccgtctccttctggaagacacccgtggagtgtggcatcggcttcaccatcatcctcagcgggctgcccgtctacttcttcggggtctggtggaaaaacaagcccaagtggctcctccagggcatcttctccacgaccgtcctgtgtcagaagctcatgcaggtggtcccccaggagacatagccaggaggccgagtggctgccggaggagcatgcgcagaggccagttaaagtagatcacctcctcgaacccactccggttccccgcaacccacagctcagctgcccatcccagtccctcgccgtccctcccaggtcgggcagtggaggctgctgtgaaaactctggtacgaatctcatccctcaactgagggccagggacccaggtgtgcctgtgctcctgcccaggagcagcttttggtctccttgggccctttttcccttccctcctttgtttacttatatatatattttttttaaacttaaattttgggtcaacttgacaccactaagatgattttttaaggagctgggggaaggcaggagccttcctttctcctgccccaagggcccagaccctgggcaaacagagctactgagacttggaacctcattgctaccacagacttgcactgaagccggacagctgcccagacacatgggcttgtgacattcgtgaaaaccaaccctgtgggcttatgtctctgccttagggtttgcagagtggaaactcagccgtagggtggcactgggagggggtgggggatctgggcaaggtgggtgattcctcccaggaggtgcttgaggccccgatggactcctgaccataatcctagccccgagacaccatcctgagccagggaacagccccagggttggggggtgccggcatctcccctagctcaccaggcctggcctctgggcagtgtggcctcttggctatttctgtgtccagttttggaggctgagttctggttcatgcagacaaagccctgtccttcagtcttctagaaacagagacaagaaaggcagacacaccgcggccaggcacccatgtgggcgcccaccctgggctccacacagcagtgtcccctgccccagaggtcgcagctaccctcagcctccaatgcattggcctctgtaccgcccggcagccccttctggccggtgctgggttcccactcccggcctaggcacctccccgctctccctgtcacgctcatgtcctgtcctggtcctgatgcccgttgtctaggagacagagccaagcactgctcacgtctctgccgcctgcgtttggaggcccctgggctctcacccagtccccacccgcctgcagagagggaactagggcaccccttgtttctgttgttcccgtgaatttttttcgctatgggaggcagccgaggcctggccaatgcggcccactttcctgagctgtcgctgcctccatggcagcagccagggacccccagaacaagaagaccccgcaggatccctcctgagctcggggggctctgccttctcaggccccgggcttcccttctccccagccagaggtggagccaagtggtccagcgtcactccagtgctcagctgtggctggaggagctggcctgtggcacagccctgagtgtcccaagccgggagccaacgaagccggacacggcttcactgaccagcggctgctcaagccgcaagctctcagcaagtgcccagtggagcctgccgcccccgcctgggcaccgggaccccctcaccatccagtgggcccggagaaacctgatgaacagtttggggactcaggaccagatgtccgtctctcttgcttgaggaatgaagacctttattcacccctgccccgttgcttcccgctgcacatggacagacttcacagcgtctgctcataggacctgcatccttcctggggacgaattccactcgtccaagggacagcccacggtctggaggccgaggaccaccagcaggcaggtggactgactgtgttgggcaagacctcttccctctgggcctgttctcttggctgcaaataaggacagcagctggtgccccacctgcctggtgcattgctgtgtgaatccaggaggcagtggacatcgtaggcagccacggccccgggtccaggagaagtgctccctggaggcacgcaccactgcttcccactggggccggcggggcccacgcacgacgtcagcctcttaccttcccgcctcggctaggggtcctcgggatgccgttctgttccaacctcctgctctgggacgtggacatgcctcaaggatacagggagccggcggcctctcgacggcacgcacttgcctgttggctgctgcggctgtgggcgagcatgggggctgccagcgtctgttgtggaaagtagctgctagtgaaatggctggggccgctggggtccgtcttcacactgcgcaggtctcttctgggcgtctgagctggggtgggagctcctccgcagaaggttggtggggggtccagtctgtgatccttggtgctgtgtgccccactccagcctggggaccccacttcagaaggtaggggccgtgtcccgcggtgctgactgaggcctgcttccccctccccctcctgctgtgctggaattccacagggaccagggccaccgcaggggactgtctcagaagacttgatttttccgtccctttttctccacactccactgacaaacgtccccagcggtttccacttgtgggcttcaggtgttttcaagcacaacccaccacaacaagcaagtgcattttcagtcgttgtgcttttttgttttgtgctaacgtcttactaatttaaagatgctgtcggcaccatgtttatttatttccagtggtcatgctcagccttgctgctctgcgtggcgcaggtgccatgcctgctccctgtctgtgtcccagccacgcagggccatccactgtgacgtcggccgaccaggctggacaccctctgccgagtaatgacgtgtgtggctgggaccttctttattctgtgttaatggctaacctgttacactgggctgggttgggtagggtgttctggcttttttgtggggtttttatttttaaagaaacactcaatcatccta

SEQ ID NO: 225 - DNA, 6128 bp, Homo sapiens
gggcctgcctgccagctagccggagccgcgggtgagcgcggcgagcggcgaccctggtgaggagcgcggcgcgggaggcacgttccttagctccgccgcggccgtcctccgcggctcgaggactccgcttccttccctcccctcccctgcgctccggcctggggtctcggcgcggggagcggagggaagggacgaaggaggagtaggtgaaagcggggtgaggggcggaagggtcccggcgcggggtgaggcgagggctgcctcttgttctcccgccgctgccgccgtctcctggtcgggtgccgcggccagaggcgcgcggggctgccgaggcacccgcactatgcaggcagactgccggccgccgcgatggcgagccgggcggtggtgagagccaggcgctgcccgcagtgtccccaagtccgggccgcggccgccgcccccgcctgggccgcgctccccctctcccgctccctccctccctgctccaactcctcctccttctccatgcctctgttcctcctgctcttacttgtcctgctcctgctgctcgaggacgctggagcccagcaaggtgatggatgtggacacactgtactaggccctgagagtggaacccttacatccataaactacccacagacctatcccaacagcactgtttgtgaatgggagatccgtgtaaagatgggagagagagttcgcatcaaatttggtgactttgacattgaagattctgattcttgtcactttaattacttgagaatttataatggaattggagtcagcagaactgaaataggcaaatactgtggtctggggttgcaaatgaaccattcaattgaatcaaaaggcaatgaaatcacattgctgttcatgagtggaatccatgtttctggacgcggatttttggcctcatactctgttatagataaacaagatctaattacttgtttggacactgcatccaattttttggaacctgagttcagtaagtactgcccagctggttgtctgcttccttttgctgagatatctggaacaattcctcatggatatagagattcctcgccattgtgcatggctggtgtgcatgcaggagtagtgtcaaacacgttgggcggccaaatcagtgttgtaattagtaaaggtatcccctattatgaaagttctttggctaacaacgtcacatctgtggtgggacacttatctacaagtctttttacatttaagacaagtggatgttatggaacactggggatggagtctggtgtgatcgcggatcctcaaataacagcatcatctgtgctggagtggactgaccacacagggcaagagaacagttggaaacccaaaaaagccaggctgaaaaaacctggaccgccttgggctgcttttgccactgatgaataccagtggttacaaatagatttgaataaggaaaagaaaataacaggcattataaccactggatccaccatggtggagcacaattactatgtgtctgcctacagaatcctgtacagtgatgatgggcagaaatggactgtgtacagagagcctggtgtggagcaagataagatatttcaaggaaacaaagattatcaccaggatgtgcgtaataactttttgccaccaattattgcacgttttattagagtgaatcctacccaatggcagcagaaaattgccatgaaaatggagctgctcggatgtcagtttattcctaaaggtcgtcctccaaaacttactcaacctccacctcctcggaacagcaatgacctcaaaaacactacagcccctccaaaaatagccaaaggtcgtgccccaaaatttacgcaaccactacaacctcgcagtagcaatgaatttcctgcacagacagaacaaacaactgccagtcctgatatcagaaatactaccgtaactccaaatgtaaccaaagatgtagcgctggctgcagttcttgtccctgtgctggtcatggtcctcactactctcattctcatattagtgtgtgcttggcactggagaaacagaaagaaaaaaactgaaggcacctatgacttaccttactgggaccgggcaggttggtggaaaggaatgaagcagtttcttcctgcaaaagcagtggaccatgaggaaaccccagttcgctatagcagcagcgaagttaatcacctgagtccaagagaagtcaccacagtgctgcaggctgactctgcagagtatgctcagccactggtaggaggaattgttggtacacttcatcaaagatctacctttaaaccagaagaaggaaaagaagcaggctatgcagacctagatccttacaactcaccagggcaggaagtttatcatgcctatgctgaaccactcccaattacggggcctgagtatgcaaccccaatcatcatggacatgtcagggcaccccacaacttcagttggtcagccctccacatccactttcaaggctacggggaaccaacctcccccactagtgggaacttacaatacacttctctccaggactgacagctgctcctcagcccaggcccagtatgataccccgaaagctgggaagccaggtctacctgccccagacgaattggtgtaccaggtgccacagagcacacaagaagtatcaggagcaggaagggatggggaatgtgatgtttttaaagaaatcctttgaagatgatgctgctttttacaaagcatcgttttaaagcacatggccttttttttttaattattagtggtagtaatatatagaatgtattacataactgtcactgaagtggttggggaaaatgtggtgactgaggtacaggaaactactaatcttgccatcttgctttaaggtgttatggtggcacagttactgctcgcctgttaaatttcaaatgtcctgtttgatactactgtagaacactatttttaatacagaaaaagctccctataatgcacttcagagaaattaaaaatcacagagtatttattaccaatgctgcaggtacattaatgaactcgagatggctctgtaagcctgactggcaataacgcacggtactgttcttgaaatacctaatggcttgaaattctagtctgtttgtgaaagatgggtactatcatgatttcctcttctattcctatattcttttctggattttttttaataattagtgatataagcattgtttttattgcagccatatccacttatccatcttaagatctgtagctgggattttctgacttgtaatgagcagggggattgctttttcactttgtgacactctttagagctttaatgcttcacagtatatggcctggtctcatccttgcgtgttccacttgaggccctttggtgtcttgccccattcttgtgtttataaaatgtttgagtatttctgatgagtgatgcttgccttagtctcatgaattcagatcccttcatgtcctttaagtatgctcctcaatgtgtaaacaggaacaactttatgatttgaaagctttaaaggagattcttctcccacccccaactttatttgcaatgggatttttcctaggagagttatgaaaagttgaaggcttctaagggaatactgtaaacatgacccacttatatttatcacagtgaaaggcaaaattattcactcagaagtaatataaattacctctttaaaaagtaaccagaatttgtcctttttggttttatacattcacaaacatatacatttttcttgagtctcaaggtattttatatttttagtcagaaaaaataatttttcatttcagttttccataaactgttacacaaaatataaacctaacgtgtatttttcaggactgcgtgatcgtgcactttgtgtggtaagaggtttgagtagtcctatatgtcacctagggaacagacattatagcttactagcaaatgaatattcatgccttgtttttgatacctcctggcagcttccatgtcaccacttgttcatacctgcccagagctagttttagacatggcaaaatagaaatcatctgtaatttattagctaacaatgtaaaaccatcttttaaagccttcagactgtcaagacgacatgagcagctcaccatatgataaaaatacataaatttgacattccctcttccataaacctttgtttgtagatttaatgttgaacagtacttttccataaagttctagtcacttctgttggcctgagccaccagattatgatgttgccagaattcactcaatttgaataaagatgaacagtatttgttttcttgtttccatgaattatatcagtattctaaaacatcgcttcagaaagagaactgtttatttctgcaggcttcctgtccttttgtggtatggttttttggccttattttcactggcttttccttctccaaactttgaggcgtgatttcattcattgaagaatcaatacatattttgtttcaaaatgtttgaaacaaaagacatagatggtagacttttattaaaacatatatggatgtggaaagcacatatattaatgcagtcatcccttttcaggtgggaagagagcaaaccagttgattttttaattcatccttagtacacagagaatatacttttcctcaagtaatatacctgtttgaagctttaagagagatgtttttggtaactatttcattttcccaaagaagtttgctattcttgtgttaattgtgtatacctgattgttttttcctggaggtttttgttgttgttgtttagttttgggtttttttttttttaagaggggcaagtgttttctgaaatgatgcatattttaagactcgattcatattgccactgtgctatccttgaactaccaataatttttataaaatatctagtttttactacttttatataaactttactttccagatgaagagctgagcctgattcaaatggtttttctgctttatacttctttttagttcattggtttttatagtagaggttttctattttttttttttttttttttactacatttatatgtctgatacatatacggctttggagacaatcaagtaacaactgaaaatgtgaaagtaaccatatctgacaaaattcccttgaatttttatcctttgcttgcaacatttaagactcaaagtcactggtatattggattaagttttttcctgttaatgcaattatagaaatacatcggagacacaacaaatgtggccattacaggtttcataaaattacactgacttggctgttacttgatcttaggaaacagcacagtttaagatattgtgaattctgacttatactttattaaatgctgtaaatctaaatagatcctgttggatgtgatgggtctagtccagtttatttaagttcatgtttcactgtttgcactttgcattgaacaatgggtttattcgctgatgtaaacggttcgagtgaagaattaatgcagtaagtatgacaacacatacacacttgcctctccccatctccagaagaggggagcagagtccgagcttatctaaatatgaatgtggccacaaagctgtggaaggtgacaaagcttaaacacctttgccctggctctgcattgtcacctagagagcaagaggtctatagaaacatcatgtcacatgaaacgattctctgctttttggttctgaacttgaagtccctaaactgcaaaatctaagagttgggtggttattaaaatgcttttaaagtcaactgtggcaccaattctaatgtaatccaacttgtgactgtttttttttgttttgttttgtttttgtgtgtgtgtgtgtggcactgggaaaagtggaaacaaacatgtattgaaatacatattggaaataaaaatggtttgagcgtcagtgatattctcccagaatgtacttatcttacctcggcatgtactgtagtcactcagtatttgtatatgttgctagaatttagattgtaaaatagtgaaattttaatgtgttcatttgtttttaatgtatatatgtcttgctcagattatttggtttaaataaaacaaccttgaggtttgtagcttttccttatactataaaatgccagattcttctattttaacctca

SEQ ID NO: 226 - DNA, 2671 bp, Homo sapiens
agttccgtcctgacagagttcacagcatatattggtggattcttgtccatagtgcatctgctttaagaattaacgaaagcagtgtcaagacagtaaggattcaaaccatttgccaaaaatgagtctaagtgcatttactctcttcctggcattgattggtggtaccagtggccagtactatgattatgattttcccctatcaatttatgggcaatcatcaccaaactgtgcaccagaatgtaactgccctgaaagctacccaagtgccatgtactgtgatgagctgaaattgaaaagtgtaccaatggtgcctcctggaatcaagtatctttaccttaggaataaccagattgaccatattgatgaaaaggcctttgagaatgtaactgatctgcagtggctcattctagatcacaaccttctagaaaactccaagataaaagggagagttttctctaaattgaaacaactgaagaagctgcatataaaccacaacaacctgacagagtctgtgggcccacttcccaaatctctggaggatctgcagcttactcataacaagatcacaaagctgggctcttttgaaggattggtaaacctgaccttcatccatctccagcacaatcggctgaaagaggatgctgtttcagctgcttttaaaggtcttaaatcactcgaataccttgacttgagcttcaatcagatagccagactgccttctggtctccctgtctctcttctaactctctacttagacaacaataagatcagcaacatccctgatgagtatttcaagcgttttaatgcattgcagtatctgcgtttatctcacaacgaactggctgatagtggaatacctggaaattctttcaatgtgtcatccctggttgagctggatctgtcctataacaagcttaaaaacataccaactgtcaatgaaaaccttgaaaactattacctggaggtcaatcaacttgagaagtttgacataaagagcttctgcaagatcctggggccattatcctactccaagatcaagcatttgcgtttggatggcaatcgcatctcagaaaccagtcttccaccggatatgtatgaatgtctacgtgttgctaacgaagtcactcttaattaatatctgtatcctggaacaatattttatggttatgtttttctgtgtgtcagttttcatagtatccatattttattactgtttattacttccatgaattttaaaatctgagggaaatgttttgtaaacatttattttttttaaagaaaagatgaaaggcaggcctatttcatcacaagaacacacacatatacacgaatagacatcaaactcaatgctttatttgtaaatttagtgtttttttatttctactgtcaaatgatgtgcaaaaccttttactggttgcatggaaatcagccaagttttataatccttaaatcttaatgttcctcaaagcttggattaaatacatatggatgttactctcttgcaccaaattatcttgatacattcaaatttgtctggttaaaaaataggtggtagatattgaggccaagaatattgcaaaatacatgaagcttcatgcacttaaagaagtatttttagaataagaatttgcatacttacctagtgaaacttttctagaattatttttcactctaagtcatgtatgtttctctttgattatttgcatgttatgtttaataagctactagcaaaataaaacatagcaaatggcatcactgtgtttgacttcttgtgaaatttctgtactttgtatataaaatacataaaacaatagattagaaatcaaaagatatctctggcctgcaatattttactgatgtgaacataggattttccactaaataatttgtctacttctagcattcacttacaaagagttcttaaaaacacctataataggtacttagatttcacaacttacttagatatttgtcattattcccattcctggtgtttttactggttcatatacaatggtattctattagataagaagctgctatgtgatctcagcactcactccttggttgtcaagaaatggtggataactcacaggattaaaaatgaatgaatataaaattttctgaaatagatatttaaaaaatcattttagcttgaagccaatatgtctggatcataggttttgagttcataatccagtaataacagctttcagctttctatgagtatatacaattctatacaatgataaatactctgcatataatttataaaaataacttctgttttacctagttaacaataaaacctatgtgtggagccaaatgttatgcagacaaaggtctgctcatcccataccagtgtatatatagtcaaatatgtgtctagtacaaataaaatgtatctctaaggcataaaatgttttaacacaccacttttagtgaactctatcttatggtacagcggcctttcatcagaggatcatcattgagactgagttgactggcagatatgtgcgatggatattacattaggtacaatgtgtatttttgattttcatgagttttctacattaaggtaaattccttagagtgtgatagcagcctcagtttatttgttggtttaaacttgaaatctactttttctcgataaaactataatgtagatgaa

SEQ ID NO: 227 - DNA, 3787 bp, Homo sapiens
agacctcgcggggccccagcgggaagcgcgggcggcggcgggatgcgcgctctgggcggcggggcgcggcgctaggcgcccggcggggcttccccaggctgcgaccccgcgggaccctccactcctcccgccgcctccgcagcccgcgcgccggagcatgagtcccggccggagccccacggccgcgggcggcgcctaggacggcgatccgcgccctggaggatccgccggccgcccggctccactacagctccagccgcctgcagcggggccctcctgaggccccagaggaagagaccatgaaagtgaggtcggccggcggcgatggagatgccttgtgcgttacagaagaggacctggcgggtgacgacgaggacatgccgaccttcccatgcacccagaagggccggccagggccccgctgcagccgctgccagaagaacctatctttgcacacatcggtgcggattctttacctcttcctggccctgctcctggtggccgtggctgtgttggcctctctggttttcagaaaagtggactctctctccgaagacatctccttgacccagtctatttatgacaagaagcttgtgttaatgcagaaaaatctccagggcctggatccgaaagccctgaacaactgctctttctgccatgaagctgggcagctggggccagagatccgaaaactgcaggaggagctggagggaattcagaagctgcttctggcccaggaggtgcagctggaccagaccttacaggcccaggaggtgctctccaccaccagcagacaaatctcccaggagatgggcagttgctccttctccatccaccaggttaaccagtctctggggctcttcctggcccaggtgagaggctggcaggccaccacagctggcctggacctctctctgaaggacctcacccaggagtgctacgatgtcaaggctgcagtgcaccagatcaacttcaccgtggggcagacttccgagtggatccacgggatccagcggaagacagacgaggagaccctgaccctccagaagattgtcaccgactggcagaactacacacggctcttcagcggcctgcgcaccacctccaccaagactggagaggcggtcaagaacatccaggccaccctgggggcctcctcacagcgcatcagccagaactcagagagcatgcacgacctggtactccaggtcatgggcttgcagctgcagctggataacatctcgtccttcctggatgaccacgaagagaacatgcatgatcttcagtaccatacccactacgcccagaaccgcactgtggagaggtttgagtctctggaaggacgcatggcttctcacgagattgaaattggcaccatcttcaccaacatcaatgccaccgacaaccacgtgcacagcatgctcaagtacctggatgacgtgcggctctcctgcacgctgggcttccacacccatgccgaggagctctactacctgaacaagtctgtctccatcatgctgggcaccacagacctgctccgggagcgcttcagcctgctcagtgcccggctggacctcaacgtccggaacctctccatgatcgtggaggagatgaaggcagtggacacacagcatggagaaatccttcgcaatgtcaccatcctacgaggtgcccccggccctccaggaccaagaggattcaaaggagatatgggcgtgaaagggcctgttggcggcagaggcccgaaaggagaccccggcagcttgggccccctgggaccccagggtcctcaggggcaacctggagaggccgggcctgtgggagaaaggggccctgttggccctcgagggttcccaggcctcaaaggctcaaagggcagctttggaactggagggccgagaggacagccaggcccaaaaggggacatagggcccccagggccagaagggcccccggggtctccagggccctcagggcctcagggaaaaccgggaattgcagggaagacagggtcaccaggccagcggggggccatggggcctaagggtgaaccagggatccagggtccccctggtctcccggggcctccaggtccaccaggaagccagagcttctactgaggagggctgtggcagagccactgtcacacagaatgccggaggggcgcagagcagatccaggccccagaaagcctcacctacagacagctgtggtcctctgattccaatgagggggctccccagggctgaccctgcagctttgggctcccccatagtgactgtgccataggaaagcagcccctcctcacacatacatgtgcacatgcacacacatgcatgcacacacatgcacacatacacgcacatgcacacatacacatgcatgcacacatacacaggcatacatgcatgcacacacacatgcacgcacacacacatgcacacatacacgtgcacacatacacaggcacacatgcatgcacacatacacatgcacacacacatgcacacatatatgcacaggcacacacatgtacgcacacacacatgcactgcacacatatccatgcacacaaacacatatatacacatgcacatacacagatttttctgctggccaggtgggccaactgggtttccctggctgggcaggaggagagggcagaggaagaccccctctcctgtgactgagcctgccagggaggcagctacctcgggaggaaggtctcacatctgtctctgggcacccatgctggccagcagtttcccagggctccctggggttgaaaagccccaaggaaacctttgcgggtggggcgttactgccaaaactccagaggcaaagtggacctggcaaccacaagaccctccccataagcaggggaccagcatacccgggagctgtccctgtctgtcacagcacagtggggccacgaggctgacattctctggccttgcacacagtgccccctgagaagttcaacatttatttcttcacgtgtccagaaaattcctcaattcatccttgcctctgcccttcaggagcagcctggaaggaatccaagcaggagtttcatctgcatgggggcactctgcaggccctggaacattgggcctgagtggagatgggagacagaggcaggccagaaggttctctctgcacagctgcctcccttgctctccctgaggctggcctgccccattccccaagggggctcctctggagtggtggggaggattaggctgcagaagggccaaccccttgcaacagggcagctctcgcctcccgcacacggctctcctgatcacagctgcatgccgaccttgtcccaccgggacccacaatggcccgagccctctttgcatgggcagccagctggactaggagtgggaagggcctggacactcacagaggccccctctgtcatcactccttggcacccaccaacttcctgcacacactggcagagaggggcgctgggaaatcaccccacagggtggaggtctcctgttggctacactctaaagctgctttgccttcatgttcaaacagattcaggcaccaccccctccaccgcccgcaaggttagggcatagagttgtctccttcccaacacggacccagagagcagcccttccctgctcaaagcctttccgcaccctcctgactgtcctggatgtgcaactggtttgcactgcacaccccacggccatgtaactctcctgtccacatatgataataccattctgcatagtattactgactcagtaaagagctatttccagga

SEQ ID NO: 228 - DNA, 1616 bp, Homo sapiens
aggtctctgcgcagcccagcccgccggtccacgccgcgcaccgctccgagggccagcgccacccgctccgcagccggcaccatgcgcgagatcgtgcacatccaggcgggccagtgcggcaaccagatcggcgccaagttttgggaggtcatcagcgatgagcatgggatcgaccccacaggcagttaccatggagacagtgacttgcagctggagagaatcaacgtgtactacaatgaggctgctggtaacaaatatgtacctcgggccatcctggtggatctggagcctggcaccatggactctgtcaggtctggacccttcggccagatcttcagaccagacaacttcgtgttcggccagagtggagccgggaataactgggccaagggccactacacagagggagccgagctggtcgactcggtcctggatgtggtgaggaaggagtcagagagctgtgactgtctccagggcttccagctgacccactctctggggggcggcacggggtccgggatgggcaccctgctcatcagcaagatccgggaagagtacccagaccgcatcatgaacaccttcagcgtcatgccctcacccaaggtgtcagacacggtggtggagccctacaacgccaccctctctgtccaccagctggtggaaaacacagatgaaacctactccattgataacgaggccctgtatgacatctgcttccgcaccctgaagctgaccacccccacctacggggacctcaaccacctggtgtcggccaccatgagcggggtcaccacctgcctgcgcttcccgggccagctgaacgcagacctgcgcaagctggcggtgaacatggtgcccttccctcgcctgcacttcttcatgcccggcttcgcgcccctgaccagccggggcagccagcagtaccgggcgctcacggtgcccgagctcacccagcagatgttcgactccaagaacatgatggccgcctgcgacccgcgccacggccgctacctgacggtggctgccatcttccggggccgcatgtccatgaaggaggtggacgagcagatgctcaacgtgcagaacaagaacagcagctacttcgtggagtggatccccaacaacgtgaagacggccgtgtgcgacatcccgccccgcggcctgaagatgtcggccaccttcatcggcaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgacgaacaaggggagttcgaggaggaggagggcgaggacgaggcttaaaaacttctcagatcaatcgtgcatccttagtgaacttctgttgtcctcaagcatggtctttctacttgtaaactatggtgctcagttttgcctctgttagaaattcacactgttgatgtaatgatgtggaactcctctaaaaattacagtattgtctgtgaaggtatctatactaataaaaaagcatgtgtagaaaa

SEQ ID NO: 229 - DNA, 2589 bp, Homo sapiens
aactatgttgctgctggagatcaatgaagccgagtgaatgggggctgaatgtgcgagtccatagctgaagaggagcgccagatggtggaggaatacacttatttatgaaactgtcttgagttcttcttgaattgccagttttcagcctcctcatgcctccgtctcctttagacgacagggtagtagtggcactatctaggcccgtccgacctcaggatctcaacctttgtttagactctagttaccttggctctgccaacccaggcagtaacagccaccctcctgtcatcgccaccaccgttgtgtccctcaaggctgcgaatctgacgtatatgccctcatccagcggctctgcccgctcgctgaattgtggatgcagcagtgccagctgctgcactgtggcaacctacgacaaggacaatcaggcccaaacccaagccattgccgctggcaccaccaccactgccatcggaacctctaccacctgccctgctaaccagatggtcaacaataatgagaatacaggctctctaagtccatcaagtggggtgggcagccctgtgtcagggacccccaagcagctagccagcatcaaaataatctaccccaatgacttggcaaagaagatgaccaaatgcagcaagagtcacctgccgagtcagggccctgtcatcattgactgcaggcccttcatggagtacaacaagagtcacatccaaggagctgtccacattaactgtgccgataagatcagccggcggagactgcagcagggcaagatcactgtcctagacttgatttcctgtagggaaggcaaggactctttcaagaggatcttttccaaagaaattatagtttatgatgagaataccaatgaaccaagccgagtgatgccctcccagccacttcacatagtcctcgagtccctgaagagagaaggcaaagaacctctggtgttgaaaggtggacttagtagttttaagcagaaccatgaaaacctctgtgacaactccctccagctccaagagtgccgggaggtggggggcggcgcatccgcggcctcgagcttgctacctcagcccatccccaccacccctgacatcgagaacgctgagctcacccccatcttgcccttcctgttccttggcaatgagcaggatgctcaggacctggacaccatgcagcggctgaacatcggctacgtcatcaacgtcaccactcatcttcccctctaccactatgagaaaggcctgttcaactacaagcggctgccagccactgacagcaacaagcagaacctgcggcagtactttgaagaggcttttgagttcattgaggaagctcaccagtgtgggaaggggcttctcatccactgccaggctggggtgtcccgctccgccaccatcgtcatcgcttacttgatgaagcacactcggatgaccatgactgatgcttataaatttgtcaaaggcaaacgaccaattatctccccaaaccttaacttcatggggcagttgctagagttcgaggaagacctaaacaacggtgtgacaccgagaatccttacaccaaagctgatgggcgtggagacggttgtgtgacaatggtctggatggaaaggattgctgctctccattaggagacaatgaggaaggaggatggattctggttttttttctttctttttttttttgtagttgggagtaagtttgtgaatggaaacaaacttgtttaaacactttatttttaacaagtgtaagaagactataacttttgatgccattgagattcacctcccacaaactgacaaattaaggaggttaaagaagtaatttttttaagccaacaataaaaatataatacaacttgtttctcccccttttccttttaagctatttgtagagtttatgactaaatagtctgtgcaggttcatagaccgaagatactacacactttaaaccaattaaaaagaaccaaaagtaaatagaaaagacattgaatcaccaaggcctgggatcaacctgggctgtccacacagaaaacaaaaacccaaccaaaccaagccctgttgtgctcactggtgcaaagagaagatcagggcagcttaagtggtctaagaatccttcaggcattctttaaggagaaaaaggatacctttgattttgtgtgtttcatgctctggattttttttttttttccttctctgggtttaagagattttttttgaaatagtgaggaactgaccattatatgccttcactggcttcttgtgcaataatatgatgttttaagtgtgcaaacaagttagagctggcagctgaatgatagacaaatagtgcaaatttgccagcttggagatagaaaggaattcaacaatatatcaaatactttccttcccacctttttccttttttttttttttttctgatttgattctggttacagtgccataaaccttgttacatatgtatatcagaatgtaagaaaaaaaaatttatttaaaaatatttttcgcaaaaaaaaaaaaaatcttggtgtgtttctgttgattgtgtaaaaatttattttcattatataaatgaaactgg

SEQ ID NO: 230 - DNA, 3242 bp, Homo sapiens
agtgcactccgtgaaggcaaagagaacacgctgcaaaaggctttccaagaatcctcgacatggcaaggaggagctcgttccagtcgtgtcagataatatccctgttcacttttgccgttggagtcaatatctgcttaggattcactgcacatcgaattaagagagcagaaggatgggaggaaggtcctcctacagtgctatcagactccccctggaccaacatctccggatcttgcaagggcaggtgctttgaacttcaagaggctggacctcctgattgtcgctgtgacaacttgtgtaagagctataccagttgctgccatgactttgatgagctgtgtttgaagacagcccgtggctgggagtgtactaaggacagatgtggagaagtcagaaatgaagaaaatgcctgtcactgctcagaggactgcttggccaggggagactgctgtaccaattaccaagtggtttgcaaaggagagtcgcattgggttgatgatgactgtgaggaaataaaggccgcagaatgccctgcagggtttgttcgccctccattaatcatcttctccgtggatggcttccgtgcatcatacatgaagaaaggcagcaaagtcatgcctaatattgaaaaactaaggtcttgtggcacacactctccctacatgaggccggtgtacccaactaaaacctttcctaacttatacactttggccactgggctatatccagaatcacatggaattgttggcaattcaatgtatgatcctgtatttgatgccacttttcatctgcgagggcgagagaaatttaatcatagatggtggggaggtcaaccgctatggattacagccaccaagcaaggggtgaaagctggaacattcttttggtctgttgtcatccctcacgagcggagaatattaaccatattgcagtggctcaccctgccagatcatgagaggccttcggtctatgccttctattctgagcaacctgatttctctggacacaaatatggccctttcggccctgaggagagtagttatggctcaccttttactccggctaagagacctaagaggaaagttgcccctaagaggagacaggaaagaccagttgctcctccaaagaaaagaagaagaaaaatacataggatggatcattatgctgcggaaactcgtcaggacaaaatgacaaatcctctgagggaaatcgacaaaattgtggggcaattaatggatggactgaaacaactaaaactgcatcggtgtgtcaacgtcatctttgtcggagaccatggaatggaagatgtcacatgtgatagaactgagttcttgagtaattacctaactaatgtggatgatattactttagtgcctggaactctaggaagaattcgatccaaatttagcaacaatgctaaatatgaccccaaagccattattgccaatctcacgtgtaaaaaaccagatcagcactttaagccttacttgaaacagcaccttcccaaacgtttgcactatgccaacaacagaagaattgaggatatccatttattggtggaacgcagatggcatgttgcaaggaaacctttggatgtttataagaaaccatcaggaaaatgctttttccagggagaccacggatttgataacaaggtcaacagcatgcagactgtttttgtaggttatggctcaacatttaagtacaagactaaagtgcctccatttgaaaacattgaactttacaatgttatgtgtgatctcctgggattgaagccagctcctaataatgggacccatggaagtttgaatcatctcctgcgcactaataccttcaggccaaccatgccagaggaagttaccagacccaattatccagggattatgtaccttcagtctgattttgacctgggctgcacttgtgatgataaggtagagccaaagaacaagttggatgaactcaacaaacggcttcatacaaaagggtctacagaagagagacacctcctctatgggcgacctgcagtgctttatcggactagatatgatatcttatatcacactgactttgaaagtggttatagtgaaatattcctaatgccactctggacatcatatactgtttccaaacaggctgaggtttccagcgttcctgaccatctgaccagttgcgtccggcctgatgtccgtgtttctccgagtttcagtcagaactgtttggcctacaaaaatgataagcagatgtcctacggattcctctttcctccttatctgagctcttcaccagaggctaaatatgatgcattccttgtaaccaatatggttccaatgtatcctgctttcaaacgggtctggaattatttccaaagggtattggtgaagaaatatgcttcggaaagaaatggagttaacgtgataagtggaccaatcttcgactatgactatgatggcttacatgacacagaagacaaaataaaacagtacgtggaaggcagttccattcctgttccaactcactactacagcatcatcaccagctgtctggatttcactcagcctgccgacaagtgtgacggccctctctctgtgtcctccttcatcctgcctcaccggcctgacaacgaggagagctgcaatagctcagaggacgaatcaaaatgggtagaagaactcatgaagatgcacacagctagggtgcgtgacattgaacatctcaccagcctggacttcttccgaaagaccagccgcagctacccagaaatcctgacactcaagacatacctgcatacatatgagagcgagatttaactttctgagcatctgcagtacagtcttatcaactggttgtatatttttatattgtttttgtatttattaatttgaaaccaggacattaaaaatgttagtattttaatcctgtaccaaatctgacatattatgcctgaatgactccactgtttttctctaatgcttgatttaggtagccttgtgttctgagtagagcttgtaataaatactgcagcttgagtttttagtggaagcttctaaatggtgctgcagatttgatatttgcattgaggaaatattaattttccaatgcacagttgccacatttagtcctgtactgtatggaaacactgattttgtaaagttgcctttatttgctgttaactgttaactatgacagatatatttaagccttataaaccaatcttaaacataataaatcacacattcagtttt

SEQ ID NO: 231 - DNA, 4624 bp, Homo sapiens
gagagcgcggtggagagccgagcgggcgggcggcgggtgcggagcgggcgagggagcgcgcgcggccgccacaaagctcgggcgccgcggggctgcatgcggcgtacctggcccggcgcggcgactgctctccgggctggcgggggccggccgcgagccccgggggccccgaggccgcagcttgcctgcgcgctctgagccttcgcaactcgcgagcaaagtttggtggaggcaacgccaagcctgagtcctttcttcctctcgttccccaaatccgagggcagcccgcgggcgtcatgcccgcgctcctccgcagcctggggtacgcgtgaagcccgggaggcttggcgccggcgaagacccaaggaccactcttctgcgtttggagttgctccccgcaaccccgggctcgtcgctttctccatcccgacccacgcggggcgcggggacaacacaggtcgcggaggagcgttgccattcaagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacagatgccatctcatccggagatgatgaggatgacaccgatggtgcggaagattttgtcagtgagaacagtaacaacaagagagcaccatactggaccaacacagaaaagatggaaaagcggctccatgctgtgcctgcggccaacactgtcaagtttcgctgcccagccggggggaacccaatgccaaccatgcggtggctgaaaaacgggaaggagtttaagcaggagcatcgcattggaggctacaaggtacgaaaccagcactggagcctcattatggaaagtgtggtcccatctgacaagggaaattatacctgtgtagtggagaatgaatacgggtccatcaatcacacgtaccacctggatgttgtggagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggccgccggtgttaacaccacggacaaagagattgaggttctctatattcggaatgtaacttttgaggacgctggggaatatacgtgcttggcgggtaattctattgggatatcctttcactctgcatggttgacagttctgccagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagctgacactgggcaagcccctgggagaaggttgctttgggcaagtggtcatggcggaagcagtgggaattgacaaagacaagcccaaggaggcggtcaccgtggccgtgaagatgttgaaagatgatgccacagagaaagacctttctgatctggtgtcagagatggagatgatgaagatgattgggaaacacaagaatatcataaatcttcttggagcctgcacacaggatgggcctctctatgtcatagttgagtatgcctctaaaggcaacctccgagaatacctccgagcccggaggccacccgggatggagtactcctatgacattaaccgtgttcctgaggagcagatgaccttcaaggacttggtgtcatgcacctaccagctggccagaggcatggagtacttggcttcccaaaaatgtattcatcgagatttagcagccagaaatgttttggtaacagaaaacaatgtgatgaaaatagcagactttggactcgccagagatatcaacaatatagactattacaaaaagaccaccaatgggcggcttccagtcaagtggatggctccagaagccctgtttgatagagtatacactcatcagagtgatgtctggtccttcggggtgttaatgtgggagatcttcactttagggggctcgccctacccagggattcccgtggaggaactttttaagctgctgaaggaaggacacagaatggataagccagccaactgcaccaacgaactgtacatgatgatgagggactgttggcatgcagtgccctcccagagaccaacgttcaagcagttggtagaagacttggatcgaattctcactctcacaaccaatgaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatattcaaattatgtataaatatatattatatatttacaaggagttattttttgtattgattttaaatggatgtcccaatgcacctagaaaattggtctctctttttttaatagctatttgctaaatgctgttcttacacataatttcttaattttcaccgagcagaggtggaaaaatacttttgctttcagggaaaatggtataacgttaatttattaataaattggtaatatacaaaacaattaatcatttatagttttttttgtaatttaagtggcatttctatgcaggcagcacagcagactagttaatctattgcttggacttaactagttatcagatcctttgaaaagagaatatttacaatatatgactaatttggggaaaatgaagttttgatttatttgtgtttaaatgctgctgtcagacgattgttcttagacctcctaaatgccccatattaaaagaactcattcataggaaggtgtttcattttggtgtgcaaccctgtcattacgtcaacgcaacgtctaactggacttcccaagataaatggtaccagcgtcctcttaaaagatgccttaatccattccttgaggacagaccttagttgaaatgatagcagaatgtgcttctctctggcagctggccttctgcttctgagttgcacattaatcagattagcctgtattctcttcagtgaattttgataatggcttccagactctttggcgttggagacgcctgttaggatcttcaagtcccatcatagaaaattgaaacacagagttgttctgctgatagttttggggatacgtccatctttttaagggattgctttcatctaattctggcaggacctcaccaaaagatccagcctcatacctacatcagacaaaatatcgccgttgttccttctgtactaaagtattgtgttttgctttggaaacacccactcactttgcaatagccgtgcaagatgaatgcagattacactgatcttatgtgttacaaaattggagaaagtatttaataaaacctgttaatttttatactgacaataaaaatgtttctacagatattaatgttaacaagacaaaataaatgtcacgcaacttatttttttaa

SEQ ID NO: 232 - DNA, 8373 bp, Homo sapiens
agcagtagtcaccgcggcggcggtggcagcggcggcgggcggcggcggctcttcctctcgcctgcgctccagggcttgctgcttccagcccgtgccggtccccggccgccgccgccgccccggctcccccttggccaggccgcccgccgcgcgggctcccccggcttccccggcgccggcccaggcggcggcggccaaactccgcggcgtccccagggcgccagcttcgccctcgccgccgcggccgcgctgctcttcggctccgacatggaagatggaccttctaataatgcgagctgcttccgaaggctgaccgagtgcttcctgagccccagtttgacagatgaaaaagtgaaggcatatctttctcttcacccccaggtattagatgaatttgtatctgaaagtgttagtgcagagacagtagagaaatggctgaagaggaagaacaacaaatcagaagatgaatcagctcctaaggaagtcagcaggtaccaagatacgaatatgcagggagttgtatatgaactaaacagctatatagaacaacggttggacacaggaggagacaaccagctactcctctatgaactgagcagcatcattaaaatagccacaaaagccgatggatttgcactgtatttccttggagagtgcaataatagcctgtgtatattcacgccacctgggataaaggaaggaaaaccccgcctcatccctgctgggcccatcactcagggcaccaccgtctctgcttatgtggccaagtccaggaaaacactgctagtagaagacatccttggagatgaacgatttccaagaggtactggactggaatcagggactcgtatccagtctgttctttgcttaccaattgtcactgcaattggtgacttgattggtattctcgagctgtatcggcactggggcaaagaagccttctgtcttagtcaccaggaggttgcaacagcaaatcttgcctgggcttcagtagcaatacatcaggtgcaggtatgcagaggccttgccaaacagacagaattgaatgacttcctactcgacgtatcaaaaacatattttgataacatagttgcaatagattctctacttgaacacataatgatatatgcaaaaaacctggtgaatgccgatcgttgtgcgcttttccaggtggaccataagaacaaggagttatattcagacctttttgatattggagaggaaaaggaaggaaaacctgtcttcaagaagaccaaagagataagattttcaattgagaaaggaattgctggccaagtagcaagaacaggggaagtcctgaacattccagatgcctatgcagacccacgctttaacagagaagtagacttgtacacaggctacaccacgcggaacatcctgtgcatgcccatcgtcagccgaggcagcgtgataggtgtggtgcagatggtcaacaaaatcagtggcagtgccttctctaaaacagatgaaaacaacttcaaaatgtttgccgtcttttgtgctttagccttacactgtgctaatatgtatcatagaattcgccactcagagtgcatttaccgggtaacgatggaaaagctgtcctaccatagcatttgtacttcagaagagtggcaaggtctcatgcaattcacccttcccgtgcgtctctgcaaagaaattgaattattccactttgacattggtccttttgaaaacatgtggcctggaatttttgtctacatggttcatcggtcctgtgggacatcctgctttgagcttgaaaagttgtgtcgttttattatgtctgtgaagaagaactatcggcgggttccttatcacaactggaagcatgcggtcactgtagcacactgcatgtatgccatacttcagaacaatcacacgcttttcacagaccttgagcgcaaaggactgctgattgcgtgtctgtgtcatgacctggaccacaggggcttcagtaacagctacctgcagaagttcgaccaccctctggccgctctctactccacttccaccatggagcagcaccacttctcccagactgtgtccatcctccagttggaagggcacaatatcttctccactctgagctccagtgaatatgagcaggtgcttgagatcatccgcaaagccatcattgccacagaccttgctttatactttggaaacaggaagcagttggaagagatgtaccagaccggatcactaaaccttaataatcaatcacatagagaccgtgtaattggtttgatgatgactgcctgtgacctttgttctgtgacaaaactgtggcccgttacaaaattgacggcaaatgatatatatgcagaattctgggctgagggtgatgaaatgaagaaattgggaatacagcctattcctatgatggacagagacaagaaggatgaagtcccccaaggccagcttgggttctacaatgccgtggccattccctgctatacaacccttacccagatcctccctcccacggagcctcttctgaaagcatgcagggataatctcagtcagtgggagaaggtgattcgaggggaggagactgcaacctggatttcatccccatccgtggctcagaaggcagctgcatctgaagattgagcactggtcaccctgacacgctgtcccacctacagatcctcatcttgcttctttgacattcttttcctttttttggggggggtggggggaacctgcacctggtaactggggtgcaaacctcttcaagaaggtaacatcaaataaataagtcaagcagaggacttcctgccaatctcttctgtgaggcatcatagacactgagcaaccaggaccacccccacgttcagaaatcagctggccaagtgactccatttgacttgcaaaccagccttttctaataggctaatattgctgaggccttaaaggaaatggacaaaaattatccagaaggggtacttttccattgtatctttctaataagggtttaaaatggtactattatggtattgtacttgggctttaacatcaatgttgctttgatgttgttggatataaataggaatttttacacattactattgtgaatggtgaatgttcatgtatgacctacttgtaattaacttgagttgtagtccacagcctcaggacaaatgtcgttgaggttacagagtaagaaatgatggcaaaacgtcaaactcttatttcagagcttcatgaatttagttagactaaacataattctttaagttcaacctaaagggctgagatcaataaatttaacactagacgaagtagacttcctgtctttttgagaagagatgaggtatatgttacaataaatctcagaacttcaagtagcagttcaaaagatgtcagtttttaaaattgtttttgttgttgtcttggcagttttactgaaccctttgcataaagaacaaaataaaagctcggcattgtaatttttttaatggacaagtcttatggatacgaagggtacatttttcataatgattcctttatattttcactttgtgtcattgcagaattttagactctcattcacaatgaaaagtttattttaaacattgtttaattaaaataccatacagttctcttttaaacatcaaaccataaaaagtgtattttgtaattttactctgacctgccgcagtcacctctcacttatctcttccacgtactgcacggtcgtatttcatgagctttctgtccatagcacagaaacagagcagaaagtagtacaatcatgttggaccttctttctgttctctttactcttctcacagatcagatcactccatagaagcctgtgggtttcgatggtttcttctatacacctttttggttgaccagtattactatacaatgtaagtgttttaaaaaatacgaaagtaatactctgcaccccttcctacaaagatgataaagcagtcacttctggcgcattttaataatttaaagatttttagtgcaatggcacggtaacctccaaacctgaattagacagagactcactcaggaagtgacaggcccatcatatcaaataacttattcacttttcatgtggcaggaaactggaatatcgcttttaataaaatggaaaaatatgcttctacatatttaccaccataggcgttttgttcatatgagcctggtttgtgcaaaattaaatcagaggcttctacaacatggtttatttatgttgtagcaaagttggctctacataaacattgttcttattttaaaattaacactatgtgttcagttttcttgtgggcttctgaaagttgccatcttccctccgtggagctccatttgctattttcattatacactatgaggtaaaatgtaataacaaaagagagagaagtaccactgtggctagatatatacacacacatatatatatggatggatgtaatatatgtagaacacacacatagatgtatataggatacacactcatgtatgtaaacgtatacatatgtgtatatatgatacatacacatacacacacacgagagacagaaggaaagagaggaagagagaagcaaacatgtaggaaaaaatataaatcagccccattctcccattctttaagaacaatgatttttcttgatggaaaatgcatatcacttgacagttgacaagaaagtgtcatttttgtgttagtgtatcatataattgaatttgaacaagatacatatttttctgcatacaaatttatgaagctggagtctaccaaacacagctttagtcacaaaagttagtttagttatctcatttcgcttggagatggaatttcaggaagggatatattatttaagattattgtttaattacaagaattttaaaagaatgtatgaattctgttttttaatatagaaaataattatggagttaggaatctcatggctacatttacatttttaggttattacagaaaattctcttaatttattatagtcaagtgtattatgtaatctctatttagaacagtttcccaaaggaatgtgattggatttactggttggttaatttcttgtgaaatattgtcataatagaagcacagcttgaacaaaagactgaattctgatataaactgtcaatattgcttttaccatgtgtaagatttacttagtaatcacagatttacctaaaataaaaggacccgggttgcagtgatatttagttaatgatttgttttggaaaacatgcagttaggagtatttttgtattttgtcagatgtttaggagacagactttcgggtcatgtttcttgtcttgttcccagatcttttcttaaaagaacagtgtgacaccagaagccaagagatggtttttactaacaacagctttgatgagttcctattaaggtcgtattgtgtattgtgccaaattttccacccagtataaatttagtaacccgctatgagcatatgtaggatattcaatttgcagatacttttgttggttatgttggtttataatagacaagttttatggtcatatgcaattattccattatctttttggacacagtgaatatgttttttagctaaaaatgtccttggaaacataaatgcctgccaataacatggaatattgaattcgggcaatgtgaattgattaattagaaaagggtcaaaagaaatacaatggatgtggaaactaattctaaaaaatagccctattaatagggcagagactctggtccatttcccagctgtacttctctctaagaggtgtatgaaaaacccatcttgcaaaagagaccaaaatattagacacaatcgttcccattcctgactcttcaatggaaaaggaaggtacagatgtttacagtggtgccccaggtgactcgttctcaccacaacaaaagcaactaattggaaactagatgtgttcaataatagatttcctcttttttggcatgctttttagattttttttcattttgtaaaatctcagttaatttttctttattggtatatttgtgtatgcgagacaaatcctgtattgtacaggatataaatagatgcataaatccttagatacctgggttttttaataggtttaggtttgggtattgtgtttctggtcttttaactcaaaattaaggtttgagctttaataggactaaattattcacctgccttggcctgtgcctttattttaaatactgcaattttacttcttcattcatgtatttattattttgcttttcttgcttaagtataattgaaaatatttgcaggaacgcacaattcattttatcaagttgaatgaataggaccattctctcctcatcagatttctgttctttatttgacttcattgacatataccctggtgactataaccagtgaactgttcagagtcagtcttttcggcaagaacttcagagaactgtgacactggttatgatgtgattttggggggtttcaggtacctaagcatgatttttaaaatcacttctctctttacatatttcgaacatatgtttgctttctacactttgcagattttatttaggatttaattctttaaagactatattcatttagtcactatagtggatctcttctactgcaagtattcatctgatttttaaattatgtaaaatgtaaatcagccaagtatgtcatccgttatagtttccccatgctttcagcgcatggccatgagatttttacatgtgcataagtatttagccaatacacattttgctgacttctttaaccatttatattgtttaaattagtaatatccaatgcagtgcacacttttttgtcttttttccaacggaatattttggttgtctgtagcgttggaagcattttatatgataaaaatagcaagaaaaaattaaaaagtgtcaacggtgtgctggttctaaattaagaagatagaacaaagagaaagacattaatgttacctaagaaacacatttaacatccgaagaagcaatgctgtcctcacttgatgtttctcttctcaacccagcaatggagagcagggcttgcaaagccgtacagagcctacgtgctctttcctgcaagtgggagaaaactaatcaatggcacacagggccaggtgtggccctgtgaggcaaaggataatgtcacctcaggaccaaggtggaaacttacagctgaatccagggcttactaagtagggaagtcagtttacatatttcagttttcctctgatgtttttgaggtactgtgtatttgcagaagtttaagcagaagggttttgtttctattgtaagttaggttctaaaagtgtataatctgatactctagcccaactgaaatattatatcttgggcgttacagcctttgtctttttctttagtcaccttaatacccagtcctatgctgtatctctgatagcctatataaatgacatataggaatattattttccatatgatctgttgtatggtgtatatgctatgtgttcatttcgtgtgcaagttcagagtgtaatagatttacccagagaaggtgtttctatacaatgcccctacctatttgaaattacatgcttgcccaacacactgtgaaatagttaccaaaatttgtacaaatgcagcatcttcattctttctgagaagacaagatggttttctttacatgaacaaatgaacaaaagagatcctagatccataacgtagctaaggcatctaagagtttgctgttgataatcttgctgaccaaaaactactggagagtaacacaggttatatgccatcacaaatacaatgctcatgaagaactgatttgtagagtcaatgaacctgtgtccagaattttaataggctctctattggaaggagaaagaatttcaagttaacagtatctaactttatcatagttgatgttagtaaattttaaaaaatgattttatatgtatgacaaaaatctttgtaaaatgcgcaagtgcaataatttaaagaggtcttaactttgcatttataaattataaatattgtacatgtgtgtaattttttcatgtattcatttgcagtctttgtatttaaaaaacatttactgttatgtttgtataatagaacagtaatcatttattataatctaggcaagttgtaaataaattcataattcaaacagccagtatatatgcatatatgagtgttatattgcaaaatctttgttttacttacatggttaaagcagcaagaattcttttgttgatatgtaattatacacataaaatatatatatgtatgatacatgaaatatatttagaaatgttcataattttaatggatatcctttggtgtgaataattgaatacagagtttttaaaata

SEQ ID NO: 233 - DNA, 934 bp, Homo sapiens
acttgcctcaggaaccccagcctgccagcacctattccacctcccagcccagcatggcacccctgctgcccatccggaccttgcccttgatcctgattctgctggctctgctgtccccaggggctgcagacttcaacatctcaagcctctctggtctgctgtccccggcgctaacggagagcctgctggttgccttgcccccctgtcacctcacaggaggcaatgccacactgatggtccggagagccaatgacagcaaagtggtgacgtccagctttgtggtgcctccgtgccgtgggcgcagggaactggtgagtgtggtggacagtggtgctggcttcacagtcactcggctcagtgcataccaggtgacaaacctcgtgccaggaaccaaattctacatttcctacctagtgaagaaggggacagccactgagtccagcagagagatcccaatgtccacactccctcgaaggaacatggaatccattgggctgggtatggcccgcacagggggcatggtggtcatcacggtgctgctctctgtcgccatgttcctgctggtgctgggcttcatcattgccctggcactgggctcccgcaagtaaggaggtctgcccggagcagcagcttctccaggaagcccagggcaccatccagctccccagcccacctgctcccaggccccaggcctgtggctcccttggtgccctcgcctcctcctcctgccctcctctcccctagagccctctcctccctctgtccctctccttgcccccagtgcctcaccttccaacactccattattcctctcaccccactcctgtcagagttgactttcctcccattttaccactttaaacacccccataacaattcccccatccttcagtgaactaagtccctataataaaggctgaggctgcatctgcca

SEQ ID NO: 234 - DNA, 4059 bp, Homo sapiens
attgtgtagcggcgagagtggagccgagcggtgcggagcagatctggtggttctccggagagcagcttcctcgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggacgagtccggctgcagaagggggcctctctccagattgagggtctccgggtggaagaccagggctggtacgagtgccgcgtgttcttcctggaccagcacatccctgaagacgattttgctaacggctcctgggtgcatctgacagtcaattcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgcagaacgggacgctgcggatccgccgggtagagcgaggcagctctggggtctacacctgccaagcctccagcactgagggcagcgccacccacgccacccagctgctagtgctaggacccccagtcatcgtggtgccccccaagaacagcacagtcaatgcctcccaggatgtttcattggcctgccatgctgaggcataccctgctaacctcacctacagctggttccaggacaacatcaatgtcttccacattagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctacccagcccaggtgacagctatgcctcctgagacacccctgcccataggcatgccgggggtgatccgctgcccggttcgtgccaaccccccactgctctttgtcagctggaccaaggatggaaaggccctgcagctggacaagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggctcccccagcttttatagagcggcccaaggaagaatatttccaagaagtagggcgggagctgctcatcccctgctccgcccaaggggaccctcctcctgttgtctcttggaccaaggtgggccgggggctgcaaggccaggcccaggtggacagcaacagcagcctcatcctgcgaccattgaccaaggaggcccacgggcactgggaatgcagtgccagcaatgctgtggcccgagtggccacctccacgaacgtctacgtgctgggcactagccctcatgttgtcaccaatgtgtccgtggtggctttgcccaagggtgccaatgtctcctgggagcctggctttgatggtggttatctgcagagattcagtgtctggtacaccccactggccaagcgtcctgaccgaatgcaccatgactgggtgtccttggcagtgcctgtgggggctgctcacctcctagtgccagggctgcagccccacacccagtaccagttcagcgtgctagctcagaacaagctggggagtggtcccttcagcgaaatcgtcttgtctgctccggaagggcttcctaccacgccagctgcacccgggcttcccccaacagagataccgcctcccctgtcccctccgcggggtctggtggcagtgaggacaccccggggggtactcctgcattgggatcccccagagctggtccctaagagactggatggctacgtcttggaaggccggcaaggctcccagggctgggaggtgctggacccggctgtggcaggcacagaaacagagctgctggtgccaggcctcatcaaggatgttctctacgagttccgcctcgtggccttcgcgggcagcttcgtcagcgaccccagcaacacggccaacgtctccacttccggtctggaggtctacccttcgcgcacgcagctgccgggcctcctgcctcagcccgtgctggccggcgtggtgggcggagtctgctttctgggagtggccgtccttgtgagcatcctggccggctgcctcctgaaccggcgcagggctgcccgccgccgccgcaagcgcctccgccaagatccacctcttatcttctctccgaccgggaagtcagctgcaccctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagccccctctgcaggaggcagctacctcagccctgctccaggagacaccagcagctgggccagtggccctgagagatggccccgaagggagcatgtggtgacagtcagcaagaggaggaacacatctgtggacgagaactatgagtgggactcagaattccctggggacatggaattgctggagactttgcacctgggcttggccagctcccggctcagacctgaagctgagccagagctaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctgatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaaga

SEQ ID NO: 235 - DNA, 938 bp, Homo sapiens
ctccgcctggacgcagcagccaccgccgcgtccctctctccacgaggctgccggcttaggacccccagctccgacgtaagtccctctcgtgcgccacctccatccgctgcccctctgcccacgggccgggctcagatgtcgccctctggtcgcctgtgtcttctcaccatcgttggcctgattctccccaccagaggacagacgttgaaagataccacgtccagttcttcagcagactcaactatcatggacattcaggtcccgacacgagccccagatgcagtctacacagaactccagcccacctctccaaccccaacctggcctgctgatgaaacaccacaaccccagacccagacccagcaactggaaggaacggatgggcctctagtgacagatccagagacacacaagagcaccaaagcagctcatcccactgatgacaccacgacgctctctgagagaccatccccaagcacagacgtccagacagacccccagaccctcaagccatctggttttcatgaggatgaccccttcttctatgatgaacacaccctccggaaacgggggctgttggtcgcagctgtgctgttcatcacaggcatcatcatcctcaccagtggcaagtgcaggcagctgtcccggttatgccggaatcgttgcaggtgagtccatcagaaacaggagctgacaacctgctgggcacccgaagaccaagccccctgccagctcaccgtgcccagcctcctgcatcccctcgaagagcctggccagagagggaagacacagatgatgaagctggagccagggctgccggtccgagtctcctacctcccccaaccctgcccgcccctgaaggctacctggcgccttgggggctgtccctcaagttatctcctctgctaagacaaaaagtaaagcactgtggtctttgc

SEQ ID NO: 236 - DNA, 6141 bp, Homo sapiens
aatttcggttctcacagactcttacttggatgtctgtaaatccggctggactttcagcttctaagaacagtccgtttctcgaggatccaggcgcaggaggacagagcaatgggtgagagaactcttcacgctgcagtgcccacaccaggttatccagaatctgaatccatcatgatggcccccatttgtctagtggaaaaccaggaagagcagctgacagtgaattcaaaggcattagagattcttgacaagatttctcagcccgtggtggtggtggccattgtagggctataccgcacaggaaaatcctatctcatgaatcgtcttgcaggaaagcgcaatggcttccctctgggctccacggtgcagtctgaaactaagggcatctggatgtggtgtgtgccccacctctctaagccaaaccacaccctggtccttctggacaccgagggcctgggcgatgtagaaaagagtaaccctaagaatgactcgtggatctttgccctggctgtgcttctaagcagcagctttgtctataacagcgtgagcaccatcaaccaccaggccctggagcagctgcactatgtgactgagctagcagagctaatcagggcaaaatcctgccccagacctgatgaagctgaggactccagcgagtttgcgagtttctttccagactttatttggactgttcgggattttaccctggagctaaagttagatggaaaccccatcacagaagatgagtacctggagaatgccttgaagctgattccaggcaagaatcccaaaattcaaaattcaaacatgcctagagagtgtatcaggcatttcttccgaaaacggaagtgctttgtctttgaccggcctacaaatgacaagcaatatttaaatcatatggacgaagtgccagaagaaaatctggaaaggcatttccttatgcaatcagacaacttctgttcttatatcttcacccatgcaaagaccaagaccctgagagagggaatcattgtcactggaaagcggctggggactctggtggtgacttatgtagatgccatcaacagtggagcagtaccttgtctggagaatgcagtgacagcactggcccagcttgagaacccagcggctgtgcagagggcagccgaccactatagccagcagatggcccagcaactgaggctccccacagacacgctccaggagctgctggacgtgcatgcagcctgtgagagggaagccattgcagtcttcatggagcactccttcaaggatgaaaaccatgaattccagaagaagcttgtggacaccatagagaaaaagaagggagactttgtgctgcagaatgaagaggcatctgccaaatattgccaggctgagcttaagcggctttcagagcacctgacagaaagcattttgagaggaattttctctgttcctggaggacacaatctctacttagaagaaaagaaacaggttgagtgggactataagctagtgcccagaaaaggagttaaggcaaacgaggtcctccagaacttcctgcagtcacaggtggttgtagaggaatccatcctgcagtcagacaaagccctcactgctggagagaaggccatagcagcggagcgggccatgaaggaagcagctgagaaggaacaggagctgctaagagaaaaacagaaggagcagcagcaaatgatggaggctcaagagagaagcttccaggaatacatggcccaaatggagaagaagttggaggaggaaagggaaaaccttctcagagagcatgaaaggctgctaaaacacaagctgaaggtacaagaagaaatgcttaaggaagaatttcaaaagaaatctgagcagttaaataaagagattaatcaactgaaagaaaaaattgaaagcactaaaaatgaacagttaaggctcttaaagatccttgacatggctagcaacataatgattgtcactctacctggggcttccaagctacttggagtagggacaaaatatcttggctcacgtatttaagagcctgaatattccaggtaagaaaatataaaatgaggtttattttattttaataacataacactgttgctcattttgtaagtatatgtgttatagcagtttcattcaagaaaagtttaaaattaaaaagtgattatcaaagaatatcagggcctgacatccacaaaaaacaaacttaattttgattgaactaataatttataaacatgggaaacaagtcagaagtagtgacattattcctagaaaagatttaaggaaagcaaaaagacaactggtaagattaagaagccattaaccatttgcaatttatattatagtcacagaaataatttcagttatgactagctcttgccgattaatgagaagagagcagctccacaatttttaatttttttaacttttattttagattcaggggtatatgtgcaggtttgttacataggtaaactgcatgtcatgggggtttggtgtgcagataattttatcacacaattattaatcataatacccaataggtttttttctgatcttctccctcctcccaacctacaccctcaagtagaccccagtgtctcttgttctcctctgagtatccatgtgttctctttgtttggcccccatttataagtgagaacatgtggtatttgggtttctgttcctgtgttagtttgcttatgataatggcttccagctccatccatattgctacagaggacatgatcttgttgttttttatggctgcatagtattccatggtgtttgtatataccacattttcattatccagcctattattaatgcacatttaggttgattccttatctttgctattgtgaacagtgctgcaatggacatacacgtgcatgtgcctttatggtacaatgatttatatttccttgggatatgcattcctttgggaataatgggattgctgagttgaatggtaattctgagttctttgaggaatcaccaacctgctttccacagtggctaaactaatttacactcccaccaacagtgtatgtgttccattttctccacaaccttgccagcatctgttatttattgactttctagtaacagccattctgactggtgtgagatggtatgcatttctgtagtgattagtgatgatgagtgatttttatatgctttttaaatgcatatatgtcttcttttgaaatgtgttcatgttctttgcccactttctttttaatggggttgcttgtttttcgcttgtaaattttttgaagcttcttatagattctggatattagatctttgttggatgcatagttggcaaatattttctaccattctgtaggttgtctgttactttgttaattgtttcattttgttttgtttttgttttttgaaacagggtctcactttgacacccaggctggagtgcagtagcacaaacatgggtcattgtagcctcaacctcccaggctcaagcagtcctttcacctcaaccccccacatagctgggactacaggtgcttacacccaagaccagttaattttttgtatttgtttgtagagatgtgtttttccatgttgcccaagctggtcttgaactactgagctcaagcaatctgcctgcttcagcctcccaaagtactgggatttaggcatgagccaccacatctggccaatagtttcttttgatgtgcagaagctctttaatttaattagatctcctttgtcagtttttgtttttgctgcaattgcttatgttatcttcatcatgaaattttagccaagtcttatgtccagaatggtatttcttaggttatttttcagagtttttatagtttaatgttttatatttaagtctttaatccttcttaagttgatttttgtatgcagagtaagctgggggcccagtttcaatcttctgcatatggctagccagtaatcccagcaccatttattaaatggggacttctttccccattgcttgtttttgtcagctttgtccaagatcagatgattgtaggtgtacagcattatttctggactctctgttatgttccatttatctgtgtgtctgtttttctactaataccatgctgttttggttactgtagctctgtagtatggtttgaggtttggtaacttgatgcctccccttttgttctttatgtttaggattgccttggctaggctcttttttggttccatatgaattttaaagtagtttctaattctgtgaagaatgtcattggtagtttgatagggatagcattgaactatttgctcaactcaacattttaggaatttatttctgctgtctagtgctcaaaacttgcagctagaattgagggaagagagagaccttcttatattgttttatattgtttgatactcagtacctgttttaagaaaaaacaacaaggaagtaaaaccaaagacaggcagcccagcgccaggcccaaaaccaggcctgggcctgcctggcctaaacccagtagttaaaaatcaactcattgcctgtaatcccagcactttgggaggccgagacgggtggatcacgaggtcaggagatcgagaccatcctggctaacacggtgaaaccccgtctctactaaaaatacaaaaattagccgggcatggtggcacgcgcctgtagtcccagctacacgggaggctgaggcaggagaatggcgtgaacccaggaggcggagcttgcagtgagtcgagatcgcgccactgcactccagcctgggcgacagagcgaaactccgtctcaaaaaaaaaaaaaaaaaatcaactcataacttagaaaccgatgttattcatagattccagacattgtatagaagaacatttggaaactcactgccttgttctgtttctctctgaccaccagtgcatgcagcccctgtcatgtaccgcctgtttgctcaaatcaatcatgaccctttcatgtgaaatctttagtgttgtgagcccttaaaagggacagaaattgtgcattcaaggagcttggattttaaggcagcagcttgctgatgccaccagctgaaaaaagcccttccttctccaactcggtgtctgagaagttttgtctgcagctcatcctgctacagaatgaactccttgtaattctacaagatatgccatgggccttttcacaggggacacaggcttcttaaaacaacccggcttcctcaccctatgtcctttatttacaaagctgtgctcctattcatgagcatggaatgtttttccatttgtttgtgacatctcttatttctttcaggggtatcttgtaattctcattatatatatcttttgcttccttggttagctgtatttttaggtattttagtcttcttgtggcaattgtgaatgggattgcattcctgatttggctcttggcttaatgttattaacgccacattttttaaatagacaaaaatatgagattaaaaatgttgaattttactaacaataaaagttgttcaaaggaaaactataaggttcttgtttcaactctgtcataggaagaacaggacagtgagctggcacagagttagggaaactgactgtgtctcatattggctagtgagagtgatctgttggaattgtatatcaaaattttaatgtacatacattttgtctagcaattctactattgggtatttatatagtacatataaatataaatgtatatgtttagtaaatatatacttatagttagtaaatatattttatatctatttagtaaatatactaaatgtcaggcctctgagcccaagctaagccatcatatcccctgtgacctgcatgtacatacgtccagatggcctgaagcaagtgaagaatcacaaaagaagtgaaaatggcctgttcctgccttaactgatgacattaccttgtgaaattccttctcctggctcatcctggctcaaaagctcccccactaagcaacttgtgacacccacctctgcccgccagagaacaaccccctttgactgtaattttcctttaccaacccaaatcctgtaaaatggtcccaaccctatctcccttcactgactgtcttttcggactcagccagcctgcacccaggtgattaaaaagctttattgctcacacaaa

SEQ ID NO: 237 - DNA, 614 bp, Homo sapiens
agccccggtccccacgcctagaagacagcggaactaagaaaagaagaggcctgtggacagaacaatcatgtctgactccctggtggtgtgcgaggtagacccagagctaacagaaaagctgaggaaattccgcttccgaaaagagacagacaatgcagccatcataatgaaggtggacaaagaccggcagatggtggtgctggaggaagaatttcagaacatttccccagaggagctcaaaatggagttgccggagagacagcccaggttcgtggtttacagctacaagtacgtgcatgacgatggccgagtgtcctaccctttgtgtttcatcttctccagccctgtgggctgcaagccggaacaacagatgatgtatgcagggagtaaaaacaggctggtgcagacagcagagctcacaaaggtgttcgaaatccgcaccactgatgacctcactgaggcctggctccaagaaaagttgtctttctttcgttgatctctgggctggggactgaattcctgatgtctgagtcctcaaggtgactggggacttggaacccctaggacctgaacaaccaagactttaaataaattttaaaatgcaaaaactcgga

SEQ ID NO: 238 - DNA, 922 bp, Homo sapiens
gctcactctgcgcttcaccatggctttcattgccaagtccttctatgacctcagtgccatcagcctggatggggagaaggtagatttcaatacgttccggggcagggccgtgctgattgagaatgtggcttcgctctgaggcacaaccacccgggacttcacccagctcaacgagctgcaatgccgctttcccaggcgcctggtggtccttggcttcccttgcaaccaatttggacatcaggagaactgtcagaatgaggagatcctgaacagtctcaagtatgtccgtcctgggggtggataccagcccaccttcacccttgtccaaaaatgtgaggtgaatgggcagaacgagcatcctgtcttcgcctacctgaaggacaagctcccctacccttatgatgacccattttccctcatgaccgatcccaagctcatcatttggagccctgtgcgccgctcagatgtggcctggaactttgagaagttcctcatagggccggagggagagcccttccgacgctacagccgcaccttcccaaccatcaacattgagcctgacatcaagcgcctccttaaagttgccatatagatgtgaactgctcaacacacagatctcctactccatccagtcctgaggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaagagaccaataaagggcaggtgtggaaa

SEQ ID NO: 239 - DNA, 1137 bp, Homo sapiens
gtgagttctcctaatctgttaagtatctttcggtgtaagttctgacaccacaatgttaaaaaagtcggatctcaaaaaccaactgctccaagcgaagtgcacagctgtcttgcctaaagaggcctatttatagtagcctcgggtagtctggtctgggctttctcattgggtacaagtaaaggaacgaaatagccaatgaaaaggtagacttttaagtgtcgtttacattggcatttgtgacgacactctaaaattaatccaatcataaacgaaatctgattaacctcatttgaataccgcatctataaatgaacagggcctcggcgggagtgattattttctcaggtgtttgcaacagtgttctaactattaacgctacgatgcctgaacctaccaagtctgctcctgccccaaagaagggctccaagaaggcggtgactaaggctcagaagaaggacgggaagaagcgcaagcgcagccgcaaggagagctattcagtgtatgtgtacaaggtgctgaagcaggtccatcccgacaccggcatctcttccaaggcaatggggatcatgaattccttcgtcaacgacatcttcgagcgcatcgcaggcgaggcttcccgcctggcgcattacaacaagcgctcgaccatcacctccagggagatccagacggccgtgcgcctgctgcttccgggggagctggccaagcacgccgtgtcggagggcaccaaggccgtcaccaagtacaccagttccaagtaactttgccaagtaagcatctttacacctaatcccaaaggctcttttaagagccacgcatgttttcaataaatgagttgtaatcatttcattcaaaaggggggttattggacttagcaccacagtaccaatctttaatgttacgttagtactgcagaggaaataacttggaagttacagggaataacaataggtactagaaattgagtgctatgggtacgtattagatcgttagctcatttagtatcacataacactagcataaactgaaagtattgtaaatgtacagctctttggtttccgtgtgcagatttccaagttgatcgtgatgttgatccgggactcggtgtggtgacggcccgccctgagcacgaaagtg

SEQ ID NO: 240 - DNA, 396 bp, Homo sapiens
agaagctgtctatcgggctccagcggtcatgtccggcagaggaaagggcggaaaaggcttaggcaaagggggcgctaagcgccaccgcaaggtcttgagagacaacattcagggcatcaccaagcctgccattcggcgtctagctcggcgtggcggcgttaagcggatctctggcctcatttacgaggagacccgcggtgtgctgaaggtgttcctggagaatgtgattcgggacgcagtcacctacaccgagcacgccaagcgcaagaccgtcacagccatggatgtggtgtacgcgctcaagcgccaggggcgcaccctgtacggcttcggaggctaggccgccgctccagctttgcacgtttcgatcccaaaggccctttttagggccgacca

SEQ ID NO: 241 - DNA, 3336 bp, Homo sapiens
gtcacccggcagactccggagggtagagcgctgtgccggttccgctgccgctggccaggagcgcggggacagttcggggctgcgccggaggccggcccgccttcccgggggttccgttatcatgtcgctgaggcagcgcctggcccagctggttggccgtctgcaggacccgcagaaagtggcccgtttccagcggctgtgcggggtggaagcgccgccgcgccgctcagcagaccggagggaggatgagaaagcggaggcgcctctcgccggagaccctcgactgcgagggcggcagccaggggcgcctggaggcccccagcctcccgggagcgaccgcaatcagtgcccggccaagccggacggcggcggcgcccccaacggcgtgcggaacgggctggcggccgagctgggcccggcctcgccgcggcgcgcgggcgctctgcgccgcaactcgctgacgggcgaggagggccagctggcccgcgtgagcaactggccgctctactgcctgttctgcttcggcacggagctgggcaacgaactcttctacatcctgttcttccccttctggatctggaacctggaccctctggtgggccggaggctcgtggtcatctgggtgctggtcatgtacctgggccagtgcaccaaggacatcatccgctggccgaggcccgcctcgccgcccgtggtcaagttggaggtcttctacaactctgagtacagcatgccctccacccatgccatgtccggcaccgccatccccatttctatggtcctcctcacctatggccgctggcagtaccctcttatatatggactgattcttattccctgctggtgttctctagtttgcctaagtagaatttacatgggaatgcactctattctggatattattgctggattcctatataccattttaatcttagctgtcttctatccatttgtggacctgattgacaacttcaaccaaactcacaaatatgctccattcatcatcatcgggcttcatttagctttggggatcttttctttcactcttgacacctggagcacatcccgaggagacacagccgagatactaggaagtggtgctggaattgcatgtggatctcatgttacttataacatgggtctagtattagatccttctctagatacattacctttagctgggccccccattactgtgactctgtttggaaaagccatattgcggatcctcatagggatggtatttgtactaataatcagagatgtaatgaaaaagatcaccattcctttagcctgcaaaatcttcaatataccgtgtgatgatattcgaaaagcaagacagcacatggaagttgaacttccttatcggtatattacctatggaatggttggtttctccatcacattttttgttccttacatatttttctttattggtatctcttgatggagaagtattgtttatgataagaaaggagggtatcagttactgatacccaaaaatatattccaggtaaagccaggtcagaattaggcttttgcaggaatttaacttaaataattatttaagtaaattcataagagtcagtgcattttatcattgcacatccagatactgttttaggtgagctgagctatttcgttactgagaaaatgataagtatccatttagaatgttcatgtaatgtttggagagttttgtattatggattcaacttatatataatatatataaggtacataatatgcaattatatatctgatatatattatatataaaataatatacctaagtgtttttttaaactatgggagtgtattataaaatcaataataatatgcaaacagttgtgcctgtgtatttgaactacatacaggtatgttgttattaacagatatatttaacatttatttactatgggagccatttcctaattgaattgcgtaattactagaccagaatgcatatgctactatacattgatttactgcctgtttttacactgccattacctttcatgttatccatgatgttgaacatgggaggcatttttaatggaccaaatttttagaaaaattagtttttggatttttttttaagttctgtatactgttttgaatgaactttatttgcagctattctggatgtcagtttaataattcaggtactgaattttattgcttgctaattgtgcctttccgttgctaaattaagaaatgctatgtgtactgtgatgtaaaaataagacattaactttatcttaagttacatataatcaagcaaatattttaaaaaatgtatgtcagggtgacaggcataaaagtaaattacccttaactctttagcctttatttagaaagaaatgtggaatgggctaaactttctcaccaatttattagaaagctaaatggataaatacttccctttttgtagatatttttctgtgcattgtaagttataggagcaggacatattttttgtacattgtcttgattgtttatactgcaggtaggtatttccagtgaatggaaacgttgaaatttatagatgggacaatgcacatacttcatatgtaaacaaagcatttttctaaataatttggaaaggattggatttagcaccgttaacttttaatacccatttattggctatttaaggtaaattataaaacctaaaattagtatcagtattttagatcctattattttttcaactttctattattttcacagtggaaaatttgcgtatagtattaaactattcttttttctgtctacctttatattttgaagtgtggttgtacttacgttaatagtaagtgtatttgtagaaagtttttcataaagaagagattaactttccatataaataaataccaggtatgaaattactgattttagtgcaatatctgtatgattatccagaactatcacttcagatgtttctattttgggcaccataactatttgagctcatatttttataattctgattgagaatttaggggcatggtaatttttaccaaaactgaagctggtaattttaagtaaagcaactaaatttaccctttacttattagttaaaaggaaaccaaggcatgtaggaaaatattggtacgttggaaaatgtgaaaagagctttactttcaaaatgtatgtttaatgaattgaattttagggaccgtttcccataatttgggcctatgctatcctgttgatttttatgtctagcttaaaaggtatttgaaaatgttccatttgtgttttattattttctgtcctatgacagttctatgctaaatgtattttaaaataaaagccaaattgaagattaaa

SEQ ID NO: 242 - DNA, 2099 bp, Homo sapiens
gatttttgacgattccttccctgagaagagggcgaggagaagaagaaagaaaaaggagaactgaattgaattagattagcatgaaggaccttttcacgcggagactaaaagtactgcgcataacttcctgctcagaaatatatgcaaataagaagacagatcctgaaagagcaagctaggagagtacaggtcgtgctgcagttagttcattgaaaactcatttgctcttggagcagtcaggcagtgactgccttcggctttttttctgctgactaagatctcctatagagagctacaacaatgcccaaaagaaaggctgcaggtcaaggtgatatgaggcaggagccaaagagaagatctgccaggttgtctgctatgcttgtgccagttacaccagaggtgaagcctaaaagaacatcaagttcaaggaaaatgaagacaaaaagtgatatgatggaagaaaacatagatacaagtgcccaagcagttgctgaaaccaagcaagaagcagttgttgaagaagactacaatgaaaatgctaaaaatggagaagccaaaattacagaggcaccagcttctgaaaaagaaattgtggaagtaaaagaagaaaatattgaagatgccacagaaaagggaggagaaaagaaagaagcagtggcagcagaagtaaaaaatgaagaagaagatcagaaagaagatgaagaagatcaaaacgaagagaaaggggaagctggaaaagaagacaaagatgaaaaaggggaagaagatggaaaagaggataaaaatggaaatgagaaaggagaagatgcaaaagagaaagaagatggaaaaaaaggtgaagacggaaaaggaaatggagaagatggaaaagagaaaggagaagatgaaaaagaggaagaagacagaaaagaaacaggagatggaaaagagaatgaagatggaaaagagaagggagataaaaaagaggggaaagatgtaaaagtcaaagaagatgaaaaagagagagaagatggaaaagaagatgaaggtggaaatgaggaagaagctggaaaagagaaagaagatttaaaagaagaggaagaaggaaaagaggaagatgagatcaaagaagatgatggaaaaaaagaggagccacagagtattgtttaaaactgccctatgtagtttcataatttggtaacatgtaccttcatgttgtaaagttaatagagataaatatttttatcaaaaattttataaacacagcctttctttagcattgatttaatttcagaacatcttcatattgattattagccataaagtttctaacatgaaacatttatctataaattttgtgattatagtagtggaatacatagaaaaaaatatgctttcaactttgtgagtgaatttcgtgttgtgtaagttatatgtcaaatctttgaattttaattttactcttttatacatgtgataatttcataaagtgagggatcccaaaaaaagagtttcatccaacattcttgttctgcaggttgcttttataaagaaggtgaactattttcatgtaatgttaagagttaaacttatctttcccaaatataactttattattagcttgggaaaaatgaaattgtattcccatttttaaaataaatacaaatgtttatttcagaagggcagttttgattatatgtgaatacacaaattttactggatttatcttaataaaaagactctgacgatgattgtgttttgttatatcttcaaaaatatagctagtgaaatattgtgcttaatttttttctattgtgttattcatgaaaatatttaatattcactgacataaaattaatataaagtaaaattcaccattttaattataataaaaataaagtatataattcaatggttgtcagtatattcacaatgttgtgtccactgtttaattccagagaatttttatcacccaaataagaaacaaagcaccaattagcagtctcttcccattttcgcccaacttatcccccacctccatcccttggcaaccactaatctgccttctatctctatggatttgcctattctgaacatttattataaatggaatcacataa

SEQ ID NO: 243 - DNA, 2096 bp, Homo sapiens
tgactggtcaccctgccacccagtgctcacaccctctggccagtgcctggctatggcccgactgctcaggtctgcaacctgggagctgttcccctggaggggctactgctcccagaaggcaaagggagagctctgcagggacttcgtagaggctctgaaggccgtggtgggcggctcccacgtgtccactgccgcggtggtccgagagcagcacgggcgcgatgagtcggtgcacaggtgcgaacctcctgatgctgtggtgtggccccagaacgtggagcaggtcagccggctggcagccctgtgctatcgccaaggtgtgcccatcatcccattcggcaccggcaccgggcttgagggtggcgtctgtgctgtgcagggcggcgtctgcgttaacctgacgcatatggaccgaatcctggagctgaaccaggaggacttctctgtggtggtggagccaggtgtcacccgcaaagccctcaacgcccacctgcgggacagcggcctctggtttcccgtggacccaggcgcggacgcctctctctgtggcatggcggccaccggggcgtcggggaccaacgcggtccgctacggcaccatgcgggacaacgtgctcaacctggaggtggtgctgcccgacgggcggctgctgcacacggcgggccgaggccggcatttccgcttcggcttctggccagaaatccctcatcacacagcctggtactcaccttgtgtgtccctgggacgtaggaagagtgcagccggctacaacctcacggggctcttcgtgggctccgaggggacgctgggcctcatcacagccaccaccctgcgcctgcaccctgcccctgaggccacagtggccgccacgtgtgcgttccccagtgtccaggctgctgtggacagcactgtacacatcctccaggctgcagtgcccgtagcccgcattgagttcctggatgaagtcatgatggatgcctgcaacaggtacagcaagctgaattgcttagtggcgcccacactcttcctggagttccatggctcccagcaggcactggaggagcagctgcagcgcacagaggagatagtccagcagaacggagcctctgacttctcctgggccaaggaggccgaggagcgcagccggctttggacagcacggcacaatgcctggtacgcagccctggccacgcggccaggctgcaagggctactccacggatgtgtgtgtgcccatctcccggctgccggagatcgtggtgcagaccaaggaggatctgaatgcctcaggactcacaggaagcattgtcgggcatgtgggtgacggcaacttccactgcatcctgctggtcaaccctgatgacgccgaggaactgggcagggtcaaggcttttgcagaacagctgggcaggcgggcactggctctccacggaacgtgcacgggggagcatggcatcggaatgggcaagcggcagctgctgcaggaggaggtgggcgccgtgggcgtggagaccatgcggcagctcaaggccgtgctagacccccaaggcctcatgaatccaggcaaagtgctgtgaagggggtctgagcacttagcccacaagttccctgactacggagccggttctggaacttttcttcatgccacggcccctgcaaggaaatagatgctgaggcagtcttcctgccagcgagcccactgtatctgggcccaaggccagagggcccagagagaagcctgagcaccgtgttacctccctggccctctggctggccccaggagcctttggttcagtaaacgacccagggtggttcccagcaaagctgcttcctctctgctcctacgcatcctgtcctggcgggaagagagcgtctgggtccattcaagactctgatgacacccctccccgaggcctcccactgccggggtcccaggacccttcccccttcacctggtgacaggaacactcctttcctggtatggaacgtgagctcccgtgacatgatgataggtcttctccttggggcctcccccaataaatctgtaataaacctgaaacccacctacagctaaaaaaaaaaaaaaaaaaaaaaaaa

SEQ ID NO: 244 - DNA, 10891 bp, Homo sapiens
actctttctctcaagaggaggcaagtggctgtggcggccgcagcagtggctgatcatcactgaaaataccaaagaaaagaactgagctgcctccttcatattttttccattgaggattaatttaccgtgctttttcattttctctacatcctgcaaaagtttttttctctcctaagaaacaaactatgaactgattgttgaaaaaaagaagtaaaaagttttagcacagcttctctgtctcttcgggacaagttagaaaattctgaagtgagccgaagcatagtaagtgctttctttctttttaagctacttctggggagggaggaggctattgtaatggtaaatttcactccgagaggaagaaagggttgataatcaatcaaaaatgaggtattcctttgagtatttgtgattttcttactatattgtaagatgcttttaattttctctgtaaaataggcagaaatggttttagtgtgtgtatgtgtgaaataaaagctcagaaaagcaatcttcagagcgccactgaaggaagttttgacgaacggagtagagatgtataccacttgggggcttcagtgagaacccagaattcctggaggaggatttacattcagaaatgttgaagtgaaaattccttctggttcagcatcttggagttcagcttggaagaacattttacgtatggaagaatttgcttctccaaacctctcttttggccattgtgtgtcctgaaggatgggacaacttgtgctgtagaagcactgcttgcctgagtttgcttcaggcattttaaatttaacttgagggatcatgtgtttggcatgatgaggaccactgaagacttccacaagcctagtgccacattaaactctaacacggccaccaagggaaggtacatttatctggaggcattcctggagggaggagctccctggggttttactctaaagggtggcctggagcacggagaaccattaatcatctctaaggtcgaagaagggggcaaagcagacaccctgagctccaaactgcaggctggggatgaggttgtgcacatcaatgaggtgactctgagcagctccagaaaggaggcagtttccctggtgaaaggatcctacaagaccctcaggctggtagtgcgcagagatgtgtgcacagacccaggccatgcagatactggtgcctctaacttcgtcagcccagaacacctcacctctggcccccagcacaggaaagcagcgtggtcaggaggggttaaacttcggctgaagcacaggcgcagtgagcctgcaggccgacctcactcgtggcacacaactaaatctggggagaagcaacccgatgccagcatgatgcagatatctcagggtatgatcggccctccttggcaccaaagctaccattccagctcctctactagtgacctctccaactatgaccatgcttatctaaggcggagccctgaccagtgcagctcccaggggagcatggagagcctggagcccagtggggcatacccaccctgtcatctttcccctgccaagtccaccggcagcattgaccagctcagccacttccataacaagagagactcggcttacagctctttctccaccagttctagcatcctagagtatccacaccctggcatctctggccgggagcgttcaggctccatggacaatacttctgctcgaggtggcctcctcgaagggatgaggcaggcagatattcgctatgtcaagacagtctatgacacccggaggggagtctcagcagagtatgaggtgaactcttcagccctgctgcttcaaggtagggaggcccgagcctcagcaaatggtcagggctatgataaatggtctaatattcctcggggcaagggagtgccacccccatcctggagccagcagtgccccagttccttggagactgccacggacaaccttcctcctaaggtgggtgcacccctgcctccagctcggagtgacagttacgcagcatttcggcaccgtgagcggcccagctcctggtctagccttgatcagaaacggctctgccggcctcaggcaaactctttaggctccctgaagtctccattcatagaggagcagctgcatactgtgctggagaagagtccagagaacagccccccagtgaagcccaagcataactatacccagaaggcccaacctggccaacctctgctgccgaccagcatctacccggtaccttccctggagccacactttgcccaggtgcctcagccttctgtgagtagcaacggtatgctctaccctgcactggccaaggagagtggatacatagcccctcagggagcatgcaacaagatggctaccattgatgagaatgggaaccagaatggatctggcaggcctgggtttgccttctgccagcccttagaacatgacttgctgtccccagtggagaagaaaccagaagctacagccaagtatgtcccctccaaagtccatttctgttcagtgcctgaaaatgaggaggatgcctccctgaagagacatctcacacctccccaaggcaacagcccacattccaatgagagaaagagcacccacagtaacaaaccatcttctcatccccacagcctcaaatgccctcaggctcaggcctggcaagcgggtgaagacaagagatcttccaggctctcagagccctgggagggcgatttccaggaagaccacaatgccaacctctggaggaggctggagagagaaggcctaggccagagcctgtcaggcaactttggcaagaccaagtcagccttctcatctctccagaacattcctgagagtctgagaagacacagcagcctggagctaggccggggaacccaggagggttaccccgggggcaggcccacctgtgcagtcaacaccaaggcagaagaccctgggaggaaagccgctcctgacctcgggagccatctggaccggcaggtttcctacccgcggcccgaggggaggaccggtgcctcggcttctttcaacagcacagacccaagtcccgaagagccgcctgccccctcgcacccgcacacatccagtctgggccggagggggcccggcccaggcagcgcctcggctcttcagggctttcagtacgggaagccccactgctcggtgctggagaaggtctccaaattcgagcagcgagagcaagggagccagagaccgagtgtgggcggctctggttttggccataactataggccccacaggaccgtctcaacttccagtacttctgggaatgacttcgaggagacaaaagcacacattcgtttctctgagtcagctgaacccctaggcaacggggagcagcacttcaaaaacggggagctgaagttggaagaggcttcccggcagccctgcggtcagcagctgagcggaggagcgtcggacagcggccgtggcccccagaggccggacgctcggctcctccgtagccagagcaccttccagctctccagcgagccagagagggagcccgagtggcgggacaggcccggctcgcccgaatcgcccctgctggatgcccccttcagccgcgcctaccggaacagcatcaaggacgcacagtcccgtgtcttgggggccacctcctttcgacgtcgagacctggagctgggggcgcccgtggcgtcgaggtcctggcggccacggccttcctcggcccacgtggggctgcggagccccgaggcgtcggcctccgcctccccgcacacgccccgggagcggcacagcgtgacccctgctgagggcgacctggccaggcccgtgccccctgccgcccggagaggtgctcgccggcgcctgactcccgagcagaagaagcgctcctactcggagcccgagaagatgaacgaggtggggatcgtggaggaggccgaaccggcacccctgggcccgcagagaaatgggatgcgtttcccggagagcagcgtggccgaccggcgccgtctcttcgagcgcgatggcaaggcctgctccacgctcagcctgtcggggcccgagctgaagcagttccagcagagcgccctggcggactacatccagcgcaagaccggcaagcggcctacctccgccgccggctgcagcctccaggagcccgggccactgcgtgagcgcgcccagagtgcctacctccagcccggccccgcggcgctcgaaggctccggcctcgcctcggcctccagcttgagctcactgcgggagcccagcctgcagccccgcagggaggccacgctcctgccggccacagttgcagaaacccagcaggctccccgagatcgcagcagctccttcgccggtggccgccgcctcggggaacggcgacgcggggacctgcttagcggagcaaacggtggaacaaggggcacccagagaggggatgagacccccagggagccatcctcctggggggccagggccgggaagtccatgtcggccgaggacctgctggaacgctcggacgtccttgcgggccctgtccatgtgaggtccaggtcatctcccgccaccgcagacaagcgccaggatgtgcttttggggcaagacagtggctttggtcttgtgaaggatccatgttatttggctggtcctggatctaggtcactcagttgttcagaaagaggccaagaagagatgctgccgctcttccaccatctcacccctcgttggggtggttcaggctgcaaagccattggtgattcctccgttcctagtgaatgtcctggaaccctggaccatcagaggcaagccagtaggacaccctgccccaggccaccactggcaggaacgcaagggctggtcacagacaccagggctgcacccctgaccccaattggcacccctctgccttcagccattccctctggctactgctcacaggacggtcagacagggcgacagcctctcccgccctacacccctgccatgatgcacagaagcaatggtcacaccctgacccagcctcccggtccaagaggctgtgagggcgatggcccagagcatggggtagaagagggaacgaggaagagggtctcgctgcctcagtggccacctccttctcgagcaaagtgggcccacgcagccagagaggacagccttcctgaggaatcctcagcccctgattttgcaaacctgaagcactatcaaaaacagcagagtcttccaagtttatgcagcacttctgacccagacacacctcttggggccccgagcactccagggaggatctccctccgaatatctgagtctgtcctgcgggactccccgccacctcatgaggattatgaagacgaagtgtttgtgagggatccgcaccccaaggccacgtccagccccacatttgaacctcttcccccacccccacctcctccaccgagtcaggaaaccccggtgtatagcatggatgacttccctccacctcctccccacactgtatgtgaggcgcagctggacagtgaggatcccgaggggccacgccccagcttcaacaaactttctaaagtgacaattgcaagggaaaggcacatgcctggtgcagcccatgtggtaggtagtcagacactggcttccagactccaaacttctatcaagggttcagaggctgagtccacaccaccctccttcatgagcgttcacgcccaacttgctgggtctcttggtgggcagccagcacccatccagactcaaagcctcagccatgatccagtcagtggaactcagggtttagaaaagaaagtcagtcctgatcctcagaagagttcagaagacatcagaacagaggctttggccaaggaaattgtccaccaagacaaatctctagcagacattttggatccagactccaggctgaagacaacaatggacctgatggaaggtttgtttccccgagatgtgaacttgctgaaggaaaacagtgtaaagaggaaggccatacagagaactgtcagctcttcaggatgtgaaggcaagaggaatgaagacaaggaagcagtgagcatgttggttaactgccctgcctactacagtgtgtctgctcccaaggctgagctactgaacaaaatcaaagagatgccagcagaagtgaatgaggaagaggaacaggcagatgtcaatgaaaagaaggctgagctcattggaagtctcacccacaagctggagaccctccaggaggcgaaggggagcctgctcacggacatcaagctcaacaacgccctgggagaagaggtggaggctctgatcagcgagctctgcaagcccaatgagtttgacaagtataggatgttcataggggatttggacaaggtggtcaacctgctgctctccctctcggggcgtctagcccgtgttgagaatgtccttagcggccttggtgaagatgccagtaatgaagaaaggagctctctttacgagaaaaggaagatcctggctggtcagcatgaggatgcccgggagctgaaggagaacctggatcgcagggagcgagtagtgctgggcatcttggccaattacctttcagaggagcagctccaggactaccagcacttcgtgaaaatgaagtccacgctcctcattgagcaacggaagctggatgacaagatcaagctgggccaggagcaggtcaagtgtctgctggagagcctgccctcagatttcattcccaaggctggggccctggctctgcccccaaacctcacgagtgagcccattcctgctgggggctgtactttcagtggtattttcccaacattaacctctccactttaacctcttctaaaatacccaaccaaaagatcactgtttctctcaacactatttaatctgaaaaatgtttcagtacaaaccactgtttgaactatctgggttattggtgtttgttcctgatgaaaggaaaaaaattctctccaggaggaagcctttttccttcttgcccttcctgattgatcttctgagagctcgaatgctgctggacacgtacccctttctattattactttgtagtagaaagaaagttaatgaaactgagaactgattggagggtgtttgatcatttagtttttaacaggctgaggcaacatggatcagtgtgtgtccccctcaggaatgtatccacagtggccttccttgctggtgggcagtgtatcctgatggcagggtacaagtaccattaatgaagggtctgcaacataaagccttaaaaagacacacactaagaaaactgtaaaaccttgaacattgttatttatattttttaaaatggaaaagatcactatgtttgttgtgctaaccacttatttgattctgttttgtggtggacatagatgattacgtttgagctttgtattttgtgaaaaccttaatgaaatgaattccaaagatagtcacgttgagcgtgaagactttttttcttacattcctgtcttatttttaccaacacgagcaggcattctgcgcttccactggactgagtatgggggagtcctgctcccctcctgtctcacaccttccccaggaggaaggcctcatgcactgcggttattgcatcatttcctagtgcttcatgtcattatcactggtggggaaacaaagctaaattttattaacaaagacaactctcagacctatataataggaggaggacgtccagaatccaacaaaattcaaacggagcccatgctgttctcctgaacaagatttgggctaaatacggcctgtttattgaggctgttttaatgatgctttaaaaaaaaaaaatgttttctaaaatgtcaaacctgttgaccacactttgattaaaaactgcctccttaacctctgaagactgattttgctttatcatgtttcaataataacatttcagaggttactctgtagccccagttgtaagcttataaaaacaaactggaaggctgaggaggttatgggctggcagccaggctatgtttacagctgctggagatggcagtagccttatactttgagcaggtagtacatcccaggctgtgctagaggtagatttgttttttcacgtttgatctgtggctggtggccacctttgttgatttgggcttacgagtttcatagtagccagtcttagaaaattgggggagtaaaattttgaagtaaaaaaaaaaaaaaaatgacaagggaaccaaatgctccttctccccttagtacattttcattacttaatgaagttttatctcctatgtaagaatatcaaaattgtagtttgggtctccagtagagatgtcttttgattaacttataaacaactggccacccagaagtttcctttgcatagtcaaccaaagctatggctttgttctttggagcttatatactgcatgactccattgatacaaataagacagcaccttggtttcccagggatgttttcattcagaggtcctgtctcccaggaaagcagtagaaccagtgacagcattcaacagccacactgcatggtcatcagtcttaggccaacatgggagcctgaaattaactccatcagtaactacctgtgtgtcttgctgatactgaatgagccctcacaagccaagccaggtggaagacagccagcaaacgtctacagttattcttagtgaaattcctcagaggaatccagggggctcccagttcccaacactcttcgagatgaccatttttcgggatttgactggggaacattttacatattcagtctttctcaaaaatttttatttattttcttgagaaagggtcttactatgttgcccaggctggagtgcagagtggtgcgataacagctcattgcagtctgaacctctgaggctcaagccatcctcccatctcagcctcccaagtagctgggaccacaggtgtgcaccactatgcttggctaattttttgattttttatagagacgggggtctcgctatgttgcccaggctggtttcaaactcctgggctcaagggatccttccgctttggtcccagaagtgctgggattacaggcatgagccacttcacccagccacttttctaatttatagacataaaagtaattgactcccacagcacagtaacaggcaatgctgcttggcatgccacaaacatctgaaagcttgtgacactcctaggattgtgtccattctttcattatgtggaaactttgttctgttatgtgaaatgggtaaggcaccaagtgagactttgaaatctaatttttaggtggatgtgatatttattgtaataggacttgacctctgtactttaaagaaatcactaaccaaattttcaaagtttccttttaaatgcgtttagctagaaatctatgtatttatccctttcctattttgcattcttctcccactatttttaaaaactcatttacagtagaaaccattcttctttctcccaacagtatcctttgccaagaccatgagaacagtaaggagcatgttgttggtcagggtttcagaatacgcgtgatgtcactgagaatgtttgctcacagtcaataattgtctttgtggatgtgataattttggagatacacttctggtcagaactcaggtgagataatcttgcaatactccaaatgcagatactccagccacccgcaaggttccaggaaaggacaatgtcctgcgagaaaatcaggaggcctccacttcctgggccacttgagaagttcctgggcatgtcactacatgttggttgactcagccatttctcatgctgttttgtttcttgcggtggccacttaaccccaaagaatgaagggaggatccacagtgaaagtgcctgagtttctctatgagaccagatgctgtcgaaaccaaacatcttttcctttgctctatgggaacattttagggtttgttttgcacagctggtttccagactagaagattaacaagtttgggtccacccctaagaatcagtggctgtcttttaaggtgaggagtgtgggcttaactgaggtcctttgagggagctataaaggagaaacaacctgggacatcccagttttcctattcctccactgttaatatctcatctaaaataattcatgagtttaaatggtaaatatatgctttaagctctacctttaaacttgtatgttattcaggcatctcttattaagatactgggtctctggatacccaaggaaatgttggctttttattcttatgtggttccaaatttacttctcttcagtttaattgtccatggtagtgctggcttcattgttaggttggagttattattttccttttagaacaacatgaattttattcaccttactattagaaaaaggaataactacagccagaaataacttcatttcctacaaggtataaaaagtggtcaagtgaatgtgaaggggcttttctacacaggaatatattatcgggaacaaagtatttcctgctgccttaactctttgggatgcataggataaaatgataaagaccattttaatatcagaaagggttgtcttattaatttttaaataaaacttcacatttcttaatggggagctcattcagaaactaaataatggtttctcaaagtgtggtcaggatacgatctgcatcagaatccttggaatgcttgttaaaaataccaattgctatgacaaaaccaagtctgctggaaactgcatttcagcaggtttcccatgttattctgatgtattttaacatttgagagccactaccaatcatctgtacagttcctactgttatgatcacaataagactaacatgaatttaataatctgaataatttttaaaatttaaataaacagaaattgaagttaaatttaaaaataaaaataacctcagaagttgaaa

SEQ ID NO: 245 - DNA, 3427 bp, Homo sapiens
atgctcagtagccgcggcgctgctgctgggctgctgggctggcgcggagtccaccctgccgtctccgccttggcttctgggcgtccagaaggccaggcatttgccgcctctgagcgcttctgttccccttacccgcaacctcctactgctcttcctctctccctctcttagggaggttgaagctggtgctggtttctgtcggcgccacagactgactgctctgcaaaccccagccgaggacctgaatcccggagactagaagacccttggcggtggctctttctaatagcactttacctgaagtggggtcgtggtggagtttctcctccacctctcaatgcaaacactatgcggagagcagtctgcttccctgcgctgtgcctgctccttaatcttcacgctgcagggtgcttttcaggaaacaatgatcattttttggcaattaatcagaagaagagtgggaagccggtattcatttataagcattcacaagacattgagaagagcctggatatagccccacaaaaaatctacagacatagctaccattcctcttccgaagctcaagtaagcaaacgccaccagattgtcaattcagcatttcctagacccgcatatgacccgtctctcaatctgctggccatggatggtcaagatcttgaagtggaaaatctcccaatcccagcagcaaatgtaattgtggtgacactgcaaatggatgtaaacaagctgaacataaccttgcttcggatcttccgccaaggagtggctgcagctttaggactcttaccccagcaagtgcacatcaatcgcctcattggaaagaagaacagtattgaactgtttgtgtctcccataaaccgaaaaacaggaatttctgatgctctgccctctgaggaagttcttcgttcacttaatatcaatgttttgcatcaaagtttatcccagtttggaattacagaagtctctcctgagaaaaatgttttacaagggcagcatgaagcggacaaaatctggagcaaagaaggattttatgctgttgtcatttttctcagcatctttgttattatagtaacgtgtttgatgattctttacagattaaaagaaagatttcagctttccttaagacaagacaaagagaaaaaccaggagatccacctatcgcccatcacattacagccagcactgtccgaggcaaagacagtccacagcatggtccaacctgagcaggccccaaaggtactgaatgttgtcgtggaccctcaaggccgaggtgctcctgagatcaaagctaccaccgctacctctgtttgcccttctcctttcaaaatgaagcccataggacttcaagagagaagagggtccaacgtatctcttacattggacatgagtagcttggggaacattgaaccctttgtgtctataccaacaccacgggagaaggtagcaatggagtatctgcagtcagccagccgaattctcacaaggtctcagctgagggacgtcgtggcaagttcacatttactccaaagtgaattcatggaaataccaatgaactttgtggatcccaaagaaattgatattccgcgtcatggaactaaaaatcgctataagaccattttaccaaatcccctcagcagagtgtgtttaagaccaaaaaatgtaaccgattcattgagcacctacattaatgctaattatattaggggctacagtggcaaggagaaagccttcattgccacgcagggccccatgatcaacaccgtggatgatttctggcagatggtttggcaggaagacagccctgtgattgttatgatcacaaaactcaaagaaaaaaatgagaaatgtgtgctatactggccggaaaagagagggatatatggaaaagttgaggttctggttatcagtgtaaatgaatgtgataactacaccattcgaaaccttgtcttaaagcaaggaagccacacccaacatgtgaagcattactggtacacctcatggcctgatcacaagactccagacagtgcccagcccctcctacagctcatgctggatgtagaagaagacagacttgcttcccagggccgagggcctgtggttgtccactgcagtgcaggaataggtagaacagggtgttttattgctacatccattggctgtcaacagctgaaagaagaaggagttgtggatgcactaagcattgtctgccagcttcgtatggatagaggtggaatggtgcaaaccagtgagcagtatgaatttgtgcaccatgctctgtgcctgtatgagagcagactttcagcagagactgtccagtgagtcattgaagacttgtcagaccatcaatctcttggggtgattaatcaaattacccacccaaggcttctagaaggagcttcctgcaatggaaggaaggagaagctctgaagcccatgtatggcatggattgtggaagactgggcaacatatttaagatttccagctccttgtgtatatgaatgcatttgtaagcatcccccaaattattctgaaggttttttgatgatggaggtatgataggtttatcacacagcctaaggcagattttgttttgtctgtactgactctatctgccacacagaatgtatgtatgtaatattcagtaataaatgtcatcaggtgatgactggatgagctgctgaagacattcgtattatgtgttagatgctttaatgtttgcaaaatctgtcttgtgaatggactgtcagctgttaaactgttcctgttttgaagtgctattacctttctcagttaccagaatcttgctgctaaagttgcaagtgattgataatggatttttaacagagaagtctttgtttttgaaaaacaaaaatcaaaaacagtaactattttatatggaaatgtgtcttgataatattacctattaaatgtgtatttatagtccctcctatcaaacaattacagagcacaatgattgtcattgggtatatatgtatttactctctattattgggcataaaggtggcttctgctccagaactctatccactgtatttccacatcgtgagtcattttactttaaaagggaaaaacaaatttgtagcaactctgaagtatcaagagttttaactacttgtctctcttttgctaagaagggatttttgaatatgctatctacctggaatctctctctcaacaaaaggtatatgccttcaggaatgatataatctgtcccattttcgaggctccttataaggacatttccatgtatgtccttacatttctgaaagctttcaatcttcaagagacaaaaaaaattaaaataactaccctcagcaaacactagctgttctgctcatatatgaatttttaatgcagcaatgttgactttgtttcatactgccaataaactcttaatactaaa

SEQ ID NO: 246 - DNA, 1896 bp, Homo sapiens
gaaagcgagtgtccctctcgcgccccaggccggtgtacccccgcactccgcgccccggcctagaagctctctctccccgctccccggcccggcccccgccccgccccgccccagcccgctgggccgccatggagcgctggccttggccgtcgggcggcgcctggctgctcgtggctgcccgcgcgctgctgcagctgctgcgctcagacctgcgtctgggccgcccgctgctggcggcgctggcgctgctggccgcgctcgactggctgtgccagcgcctgctgcccccgccggccgcactcgccgtgctggccgccgccggctggatcgcgttgtcccgcctggcgcgcccgcagcgcctgccggtggccactcgcgcggtgctcatcaccggctgtgactctggttttggcaaggagacggccaagaaactggactccatgggcttcacggtgctggccaccgtattggagttgaacagccccggtgccatcgagctgcgtacctgctgctcccctcgcctaaggctgctgcagatggacctgaccaaaccaggagacattagccgcgtgctagagttcaccaaggcccacaccaccagcaccggcctgtggggcctcgtcaacaacgcaggccacaatgaagtagttgctgatgcggagctgtctccagtggccactttccgtagctgcatggaggtgaatttctttggcgcgctcgagctgaccaagggcctcctgcccctgctgcgcagctcaaggggccgcatcgtgactgtggggagcccagcgggggacatgccatatccgtgcttgggggcctatggaacctccaaagcggccgtggcgctactcatggacacattcagctgtgaactccttccctggggggtcaaggtcagcatcatccagcctggctgcttcaagacagagtcagtgagaaacgtgggtcagtgggaaaagcgcaagcaattgctgctggccaacctgcctcaagagctgctgcaggcctacggcaaggactacatcgagcacttgcatgggcagttcctgcactcgctacgcctggccatgtccgacctcaccccagttgtagatgccatcacagatgcgctgctggcagctcggccccgccgccgctattaccccggccagggcctggggctcatgtacttcatccactactacctgcctgaaggcctgcggcgccgcttcctgcaggccttcttcatcagtcactgtctgcctcgagcactgcagcctggccagcctggcactaccccaccacaggacgcagcccaggacccaaacctgagccccggcccttccccagcagtggctcggtgagccatgtgcacctatggcccagccactgcagcacaggaggctccgtgagcccttggttcctccccgaaaacccccagcattacgatcccccaagtgtcctggaccctggcctaaagaatcccacccccacttcatgcccactgccgatgcccaatccaggcccggtgaggccaaggtttcccagtgagcctctgcgcctctccactgtttcatgagcccaaacaccctcctggcacaacgctctaccctgcagcttggagaactccgctggatggggagtctcatgcaagacttcactgcagcctttcacaggactctgcagatagtgcctctgcaaactaaggagtgactaggtgggttggggaccccctcaggattgtttctcggcaccagtgcctcagtgctgcaattgagggctaaatcccaagtgtctcttgactggctcaagaattagggccccaactacacacccccaagccacagggaagcatgtactgtacttcccaattgccacattttaaataaagacaaatttttatttcttctaaaa

SEQ ID NO: 247 - DNA, 1501 bp, Homo sapiens
ctcttcctgagaaacgagcaaacctgaaagctactctctcagcttcagagggaaaaaatggttgtagatttctggacttgggagcagacatttcaagaactaatccaagaggcaaaaccccgggccacatggacgctgaagttggatggcaaccttcagctagactgcctggctcaagggtggaagcaataccaacagagagcatttggctggttccggtgttcctcctgccagcgaagttgggcttccgcccaagtgcagattctgtgccacacgtactgggagcactggacatcccagggtcaggtgcgtatgaggctctttggccaaaggtgccagaagtgctcctggtcccaatatgagatgcctgagttctcctcggatagcaccatgaggattctgagcaacctggtgcagcatatactgaagaaatactatggaaatggcacgaggaagtctccagaaatgccagtaatcctggaagtgtccctggaaggatcccatgacacagccaattgtgaggcatgcactttgggcatctgtggacagggcttaaaaagctgcatgacaaagccgtccaaatccctactcccccacctaaagactgggaattcctcacctggaattggtgctgtgtacctcgcaaaccaagccaagaaccagtcagctgaggcaaaagaggctaaggggagtgggtatgagaaattagggcccagtcgagacccagatccactgaacatctgtgtctttattttgctgcttgtatttattgtagtcaaatgctttacatcagaatgatgaaaataggcttgccactttctcttattttaattccatggtagtcaatgaactggctgccactttaatataactgaaaattcattttgagaccaagcaggatcaagtttgtagaataaacactggtttcctagccatcctctgaaaacagtatgaaacatgaccaagtacataatggatttagtaataaatattgtcgaattgctaaaaagtcttcaatcattcattcactaagtcactcagtgatatcaatatacttagctcagaaagtgtgggaggctgaataatggtgtctcccaacatatgcatgacttaatccccagaacctgtaaacatgttactttacatggtagaatggactttgcggatgtaattaaggaccttgaaatggttagattatttcatattgtccgggtggataagaaccaggattttgtaacagggaggcaacaagctcaaaatcagaaaaaagagatttgtcaatggaacaagaggttgaagtgctttgaagttggaggaagaggtcacaggcaaaaaagtacaggcagcctttagaaacccaaaaggacaaaggaacagattctcccctggagtctgcagaaggaaccagccctgcctgcacatggctttagcccagtgacactgattttggacatctgaccttcagaactgcttgctcataaacttgtcttgttttaatgca

SEQ ID NO: 248 - DNA, 4303 bp, Homo sapiens
gtccagctggagacagccccgtggggccagccagcgctgggccaggagcggccacctggttcctgcgtgctacggccctgtgggcctgggagctgcctctgaggaacacgccgcagggccaggcatgtgaggtctctgcgggtcatggagaacctccctgccgtgaccactgaggagccgacccccatggggaggggtcctgtgggaccctcaggaggtggcagcacccgggaccaggtccggactgtggtcatgaggccctctgtgagctgggagaaagcggggcccgaggaggccaaggcgccagtgagaggcgacgaggctcctcctgcccgcgtggctgggcctgctgctgggacccctccctgccagatgggggtttatcccacagacctgaccctgcagctgctggctgtgcggaggaagagcagactgcgggaccccggcctacagcagaccctccggggccagctccgcctgctggagaatgatagccgggagatggcccgcgtgcttggggaattatcagccaggctgctgtccatccacagtgaccaggaccggatcgtggtgacgtttaagacttttgaagaaatctggaagttttccacctaccatgctctcggcttcactcatcactgcctggcaaacctgctcatggaccaggccttctggctgctcttgcccagtgaggaggaggagacggccatccaagtccatgtggatgagaacgccttaaggctgacccacgagagcctcctcatccaagaagggcccttctttgtcctgtgtcctgaccaccatgtgagagtgatgacgggtccccgggatgcaggaaatggcccccaggccctcaggcaggcttcgggggcaccccagggagaggcggccccggaaacagactcttcaccgccgagccccagcgtgtcctccgaggaggtggcagtggcggccgccccggagcctttgattccatttcatcagtgggctcttaggatcccccaggaccccatcgacgatgccatgggtggccctgtgatgcccggcaacccgctgatggctgtgggcctggcctcggcattggcagacttccagggctcggggcccgaagagatgaccttccgaggtggcgacctcatcgagatccttggggcgcaggtgcccagcctgccctggtgcgtgggccgacacgcagcctcgggccgggtggggtttgtgcggagcagcctcatcagcatgcagggccccgtgtccgagttggaaagtgcgatttttctcaatgaggaagaaaagtcattcttcagcgagggctgcttttctgaggaggatgccaggcagttgctgaggcggatgtcgggcaccgatgtctgcagcgtgtacagcctggactcagtagaggaagctgagaccgagcagccgcaggaaaaagaaatacctccaccttgcctgagcctggagccacaggagaccttgcagaaggtgaagaatgttctggaacaatgcaagacctgcccaggctgcccccaggagccagcgtcctggggtctctgtgcggcatccagcgacgtgagcttgcaggaccccgaggagccctccttctgcttggaagccgaggacgactgggaggacccagaggccctgagctcactgctgctgttcctgaacgcccctgggtacaaggccagcttccgtggcctgtacgatgtggcgctgccgtggctgagcagcgtgttccgcagcttcagcgacgaggaggagctgactgggcgcctggcacaggcccggggggcggccaagaaagctggcctcctcatggccctggccaggctctgcttcctcctggggcggctgtgcagcaggaggctcaagctgtcccaggcccgggtgtactttgaggaagcgctgggggccctggagggcagcttcggggacctgttcctagtggtggctgtgtacgccaacctggccagcatttaccggaagcagaagaaccgggagaagtgtgcacaggtggtgcccaaagccatggccctgctcctggggacgcctgaccacatctgcagcaccgaggcggagggggagctcctgcagctggcgctgcggcgggcggtgggtggccagagcctgcaggccgaggcccgggcctgcttcctgctggccaggcaccacgtgcacctcaagcagcccgaggaggccctgcccttcctagagcggctgctgcttttgcacagggactcgggagccccagaggccgcgtggctctcagactgctacctactcctggctgacatctacagccgcaagtgcctgccccacctggtgctgagctgtgtcaaggtggcctcattgcggacacggggctcgctggccggctcgctgaggagtgtgaacctggtgctccagaacgccccccagccccacagcctccctgcccaaacttcccactacctcaggcaagcgctggcctccctgaccccgggcacaggccaggcgctgcgcggccccctctacaccagcttggcccagctgtacagccaccatggctgccacggcccggccatcaccttcatgacgcaggcagtggaagccagtgctattgccggagtccgtgccatcgtggaccacctggtggccctggcctggctgcacgtgcttcatgggcagagcccggtggccctggacatcctgcagtctgtccgggatgcagtggtggccagcgaggaccaggagggcgtgattgccaacatggtggccgtggctctgaagaggacgggccggacgaggcaggcagctgagagctactaccgcgccctgcgggtggctcgggacctgggccagcaaaggaaccaggcagtggggctggccaacttcggggccctgtgcctgcatgcgggtgccagcaggctggcccagcactacctcctggaggccgtgcggctgttctcgaggctgccccttggggagtgtggccgggacttcacccacgtgctcctgcagctgggccatctctgcacccgccagggcccggcccagcagggcaagggctactacgagtgggcccttctggtcgccgtggagatgggccacgtggagagccagctgcgggccgtccagcggctgtgccacttctacagcgccgtcatgcccagcgaggcccagtgtgtcatctaccatgagctccagctctccctggcctgcaaggtggccgacaaggtgctggaggggcagctcctggagaccatcagccagctctacctgtccctgggcaccgagcgggcctacaaatccgcactggactacaccaaacgaagtctggggattttcattgacctccagaagaaagagaaggaggcgcatgcctggctgcaagcagggaagatctattacatcttgcggcagagcgagctggtggacctctacatccaggtggcacagaacgtggccctgtacacaggcgaccccaacctggggctggagctgtttgaggcggctggagacatcttcttcgacggggcctgggagcgggagaaagctgtgtccttctaccgggaccgggccctgcccctggcagtgactacgggcaaccgcaaggcggagctgcggctgtgcaacaagctggtggcactgctggccacgctggaggagccccaggagggcttggagtttgcccacatggccctagcactcagcatcaccctgggggaccggctgaacgagcgcgtggcctaccaccggctggccgccctgcaacaccgactgggccatggcgagctggcagagcacttctacctcaaggccctgtcgctctgcaactcgccgctggagtttgacgaggagaccctctactacgtgaaggtgtacctggtgctcggtgacatcatcttctacgacctgaaggacccgtttgatgcagccgggtactaccagctggcgctggcagccgccgtggacctgggcaacaagaaggcacagctgaagatctacacgcggctggccaccatctaccacaacttcctcctggaccgtgagaagtcgctcttcttctaccagaaggccaggaccttcgccacagagctcaacgtccgcagggtcaacctgcctcctctgccactctgcgggtgggccccctggttggcccccagccaccctcgctgaggacagcatccaagggagtgggttttgtgcaagggctgggggtctcctgcctctcctggtgtcgccggtggctcattttctggcaaatggaggcacgaacgcaggggccaaatagcaataaatgggttttgttttttttttgcaataa

SEQ ID NO: 249 - DNA, 929 bp, Homo sapiens
agagactcccaccccagctcagagggagcaggggcccagccagggacggaccctcattcctcccagggaccccagacctctgtctctctcggctgagtatttgtgccaggaagactgcgtgcagaaggtgactgtctcagtggagctgggtcatctcaggccttggctccttgaacttttggccgccatgtgcttcccgaaggtcctctctgatgacatgaagaagctgaaggcccgaatgcaccaggccatagaaagattttatgataaaatgcaaaatgcagaatcaggacgtggacaggtgatgtcgagcctggcagagctggaggacgacttcaaagagggctacctggagacagtggcggcttattatgaggagcagcacccagagctcactcctctacttgaaaaagaaagagatggattacggtgccgaggcaacagatcccctgtcccggatgttgaggatcccgcaaccgaggagcctggggagagcttttgtgacaaggtcatgagatggttccaggccatgctgcagcggctgcagacctggtggcacggggttctggcctgggtgaaggagaaggtggtggccctggtccatgcagtgcaggccctctggaaacagttccagagtttctgctgctctctgtcagagctcttcatgtcctctttccagtcctacggagccccacggggggacaaggaggagctgacaccccagaagtgctctgaaccccaatcctcaaaatgaagatactgacaccacctttgccctccccgtcaccgcgcacccaccctgacccctccctcagctgtcctgtgccccgccctctcccgcacactcagtccccctgcctggcgttcctgccgcagctctgacctggtgctgtcgccctggcatcttaataaaacctgcttatacttcc

SEQ ID NO: 250 - DNA, 91671 bp, Homo sapiens
aggcagaacggtcgccgcgtcgcctcagcacggacctccagggagctcctcagcaagatcctgccagggcgcccctcagcgcgattctgccggggtgcctctcagcgtggtcctccccggggctcctcagcacgattctcccggtgcgcccctcagcgcggtcctcctcggtgcgtcagtcatcgtggttctccccggcgcgcccctcggcgcggttctcctcggggctcctcagcgcggcgctcttctgggggctcctcggcgcagttctccccggggactcctcggcgccgttctcctcggggcacccggggcttttcggcgcggttctccccgggggttcttcggcgcggttgtccccgggggttcttcggcgcggttctctccgggggcctctcgccgcggttctgttctccccgggggctcctcagcatggttctcctccgcgcggtcctccctgggcctcctcagcgcggcactctcctgggggctcctcagcgcggcactctccccgggggctcctcagcgcggcactctcccggcggctcctcagtgcggttctcccagactctcctcagcgcggccctccccatctctctgggagggtttgaacacggtcagcacggacctgggcggacggcgcgggacgggtgatcactggcgttgctgaggtgagctgtgtgccccgcggccgtcccagatcacaggcgtcagcagtgcagcctggcctgggcagtgcgctcccatctgcaccttatggacagcgtggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgagaaagcaaatagcatgtcaaaatctgaccccttgcaaccagggtttcttagccagccacactggtaatgcttgggacaggatgtatctttgttgtgaggggctgtcatttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacatcgcctttttcttgtcagctctccttcctgattagtggctcaaacagccttccgagactcaaggggttaactgcagatcctctaactcctccacttgctaatttttaaacacagctgagctctgagcacccctcccaaggctgtgagaggccagaggccagcacagactctgcaccaggtctgcacagcctccacccctactgttgtcaggaatctgcaggcatctagaacaaaggtgcctccattatttccctcacccagcatatcctgatacctgagccaagagttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaacctttggtgggctcagtgcagcccctcctgcccccttgcttgggagctgtctgcagaggcctagggagctgcgtggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacacccaactcaggatatcttgcatcactttgtgggtccttgtcccccagagctgggactgctgagttttagccctaagctcttgctcccatcttagcaagtcagggcccagtgttgtccttgcctctgcatcaggatggtaagctgggcatgctccgcatcacggagacctgcatggacctggattgggttgcctctatcttcaggctggtcactgggcagacacaaaccagggcctctggccagaggggacagtggctctgagttacttgtgctgctctttaggggtgagcaggggctgcttgtgcatcatagtgtatcacaggggatgcacatttacaattgaaagctactggtcctgggtagaagtggggccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccagaccgaaggcctgaagtccacatgggacccctgaacttctggtacctgtgtgggcttgtcccctcaaccctgagtggaatggcaacagccagctgcaaccctcctagcttcctgtcatgtgctgtatggaagggccaagagctgtagtcatctgcagatcctcccactgcacctgtaggactagcgtctcctgtctggatgtgagcaacttgctggtggcctgtgagatgggagttgcactgggcttctggataagggcttctcgttcaggtgacaattctatgtgaaggagacccatggaaacacatctatcccctgcccatgtaccaggcagagatggtacctgcccatgtaccctccatgacatggctgggtccctgaaacatcagacagatcgatactctgtgtgcatgtttgtgggcaagacacagtggcacgtgtgccctggagtttggtaatgggaggactgaagtagtgcctccgtgtgtgagctgtgccagccatccccacgaagggggcattccatgcagatggggatcctctccaggcagcttcttccacacctgattagctctgaccatcagaccccccgtgccaaaagggccccttccctggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgcttccttctacccactcttcatagaacacaaacactgcaaaaatgactttttccaaaccctcttagcattcagaagtagaattgctatgtaagaattttttcataggtgcttttttggggggcatctatttaaaaaataaccacatcattagtgaaatcttccaaagtctctttttggagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaagaagtatggcatacctatggaagaagtcaaaggcaaagtgtagaaaaatacatacagtatgctaccatttgtataaaaaggagccgtatctactaagtacatgcacacacagacacacgtatatttgtttatataaaatacgtctggaaagatgcaataggaaagtgttgagtggtaacctttagggaaggaaacttgggaattagggttgggtggggagagtgttatttttcaccccttttgtactctgaattggttttaccatgtgtgtaaagactgttgtatgatttttgtagcacaacccttgaatacataaagcacgattggctccccagaaggcaggtgttggccaggcagtggatgcacggtagggcagtgtgcagccctgcatgcacgtggctggtatgccctgcgggcagcagctccccgcacacagtgctgtgagtctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtggggttcgtggggcagttcaaaaagaaaagcagaaaaaagcatttgagtattttggactggaaggaattcaatttaacttaacaaatcaggacatgaacctaaagaaaacactgaaaaacaagcccaactttgaaaggcccaaagagggaggattaggtgggagaagaaaggtcccctgtgggcagaagacagctgctcagtccagaccagggaccaggggaggatactgggcttgagtgcagaccgggccagggtagggagacaagcccaacatacactcgaggacttgaagtcaggggtgctagctgactttttagcccactctttctaccccagatacagagactagctgcctgaggaagcatagcggggcccacaggctggctgcctggtgctgcccacctcctctccagggcttggctccctggggcagaaggctcagacctataaccacagtggggttgcagggatttatttgggggaagaaccctgactgggtcagaatgattatgtgcatgcatgtatgtgtatgtagctccttgttctctgaaaagccttgcctaccaccctacttcccaagtaccctctattgccttgcaaagtcacccctgctctctgcctcagtttccccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttcccagaatgtcctttctgtcctttcccaccaaagtttacagggagagaaatatggtgaggagcttagacactcacagagctgcagtgcctggtaccctggggtctgtgggagtaggtcacagtggacctggatgtctccaaaatgtcccaggccaagctggtcccatcaaaagagctagccccttggtccatgaagccaaatttggggccacccttgtgacgtttgcccttatttccagacagcacagactggccctgtccttgctgacaaatgcagaattcaggagacattagtagtgatgtggatgaaagccaggccacagcggccttgctggaaaagagcaactcgaatgtcttggcgtgagattctgcagggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgctacatcaaccagttgtacccccaatgaggcacaggagtccctccaacagctggcttcacattatgattcctgggcccacctctgcaactttgacacaggagctcaggatactgatccttatcactccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatctatgcctgataggacagatgatcaacaattagaaaatgaaaatttaaagggtactacatacaaacttactgaaaaaaaatctaaaataaaacataaaaccataaaatatcttgaagaaaacataagagaaaatctccaggaccttggatttggcagtgaattctgaaatacgaaaccaaaagtttaactcgtaagagaaaaagaatcaacaaattggactttatcaaaattaaaagcttttgctgtgcaacagacactgctaatggaatgaaaagacaaagcacagacttggaaagaatatttgcatatcacctatcaggtcaaggacttgcactcagaatatataaagaatgcttacaacttgacaataaagtgaacaatccaattttaaaaatggattataaataagcacatgaaaagatacataattaacataaatatggaaatgcaaattagaatcacaatgaaattccataaattaaaaaaaaaattcaaaacctgacaataccaaccactcttgaggatgtggaacatgtagaactctcatatgttactggtgggaatgcaaaatggcacagtgactttaggaaatagtttagcaatttcttattaagttaaacatacacataccacatgacctatcggttcctttcccacccaagtgaattgaatttttatgttcgcaaaaacctgtacataaatgtgtatagtaactctgctcataattaccaaatactggaaacaatgaagatgtccttcaacaggtgaatgcataaacaaaatgtatatattcatgcaatggaataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagatttggggctgagattcaagtaccctaggttatataatgcagttgtcaagtgacagagctaaaacttcatccaggattcaattttttttaaaggaaggaagaaagaaaaaacatattttgatgtttgcatcacttgtatgtagaaggaacgatggagcacaggctagaacgtagagttgctttccaaacacccatgatgacaagtgcccatctccaaagcctgagggccaagggtgagccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctgaggagtgttctgtgcagcttcccagctgcccaccatgaagctctttctcaataagtgaccagcacagcttaattcctgaattaagctgtgtgtgctgtgagactgacacaagacagggtgacaggaagctgtcggaacatttgagtagggaagcagcaagatccactgtacatttaaagaactcccttgagctgttatgtgaagaatggagtacaggaagcaagagtggaaatcaagagaccagtaatgaggtatggacaacaatgtaggcagagaaatggtggtggttttaaccagggagatagctggagagactaggtgtgggcaaatccagagagttgataagacatactgatagattagaaaggggtactaagaaaaaaggataatttaaaaaagactttcagccaggcttggagaaaaatagcatgctgctcctcatcccctctgactataaatcatctcactcatcctcccctaaaagcataaaatcagtaagtgcaaataaaaccacatgacccatgctgttagcagtattaggagaaagaataccttcaaattgcctgtgggtagcaaagtgagccaaattccaatagcattctagtcccctgcccagcactgcaaaactgcatacagaatcagagaagaggcttaaaatgctttgtcaaaaagtttgaaggtagttagcaacatcagcaaaaatagaggagtaagtacctctaaggagccttcttgccttcacagacatcctaagcaccaagcagcctaagccactgatgaacttgcagataccactgatgtggattatagtctaattaattgtagagacaccacacttctgcactgaaccagaaccaaagccaaagcaccctacccaaatgatactacagacgcgtgtacaggaaaagtccttactaaggctactccataaaattggaagtctctgttattccagatatgcagatatcaacttggggacacaaaaaacttggggggaaaaaaacaagaaaacatgacttgccaaaagaacacaataattctccaataatagactccaaagtaaaggaaatcttaaggaaacccaatgagatacaagagaacacaaatagacaatacaaacatatcaggaaaacaattcattatctaaatgggaaatccagcagagttagatatgaaaaagaaccaaacaaaaatcctggaggtgataaattaaatgaatgaaataaaaaatacaattgaaagcttcaaaagccggctaagtcaagcagaagaaataatttctaaatttgaagacaggtgttttgcaataaaccagacagatttaaaaaataacaataaaaaagaatgaagaatgcctgcgtgacatatgagacactattaagctaacaatatttcacattttgggagttccagaagaagtgttgggataaggaccagaaaatctatttaagaagataatacctgaaaactgccaaagtttgggagagaaagagactaacagataaaggaagctcacaaatccctaaatagattcaaccctaaaagggcctctctgaggcacattttcatcaaactgtcaaaaatcaaagagagaatttaaaaaacaagagagaagcatgaagtcacatataagggaatcaacagcagattaacagatttttcagcagaaaccttctaggccaggaaagaattgaatgccatattaaaagtgctgcaaggtggggaaaagctcacaaaattgctagccacaaatactatacccagcaaagctatccttcagaaatgaagcagaatgagggaagaaattttgcctccctcagacaagcaaaaactgagggaattcattactactaaatcagccccacaagaaatgcttaagggagtactacatctggaagtaggaggatgatatctaccatcatgaaactacaaaagcataaaacactagtagagcagatacacaaatgagaaaggaaaaggaataaaagattatcactacagaaaaccaaaaaattgcaaagaaaaacaatgagaggaaacaaaagtatacaaatcagtcagaaaacaataaaatgacaggagtaagtcctcacctattgataacaatcttgaatgtaggtaatttaaatttcccaaatgaaagatagatactggctaaatgaattaaaaaaataaaacccaattacatgctgcctataagaaactgacttcacctgtaaagacacccatagactgtaagggaatggatagaaaaagatattccacacaaacagacaccaaaagcatgcaggagtagacagacaaaaaatactgagtcaaaaaaaaaaaaaaaaaaaaaaagaaaaagaaaaaagagacaaaggaggtcattatataattataaatggatcaattcagcaagaagatataacaattatatatgcaaccaacaacactggagtacccaggtatattaaacaaatattattagtgctaaagagatagaccccaatacaataatagttagggatggcaacatttcatactcagcattggacaattcatttggatggaaaaatatcaacaaggaaatattagatttgaactgctgcttcgttagcacacagcacattctccaggatataccatatgttaggacacaaaacgggtctcaataaatttttaaaagtcaaaatcttatcaagtatcttctcagaccacaatggaataaaactggaaatcaataacaagaggaacttctgaaattgaacagatacacggaaatcaaactacatgttcctgaatgaccactgtgtctatgaagaaattgattttaaaaatttaaaaattctttgaaacaaatgaaaatagaaacacagcatacaaaaatgtatagggtacaacaaaagaagtgctatgagggacatttatttcaataaacacccacatcaataaggtagaaagtttttaaacaaataacctaataaacgcatctcaaggaactagaaaagcaagaacaaatcaaacctaaaattagaaggaaataaatagtaaagatcagagcagatctaaatgaaatagagataaaaggtaaaaaagacaaaagatcaatgaaatgaggcctcccccccaccccccgagacacggtctcactctgtcacccaggctagagcgcagtggtgtgatcttggctcactgtaacctctgcttcctgggctcaagcaatcctcctgcctcagcttctgagtagatgtgcagcaccacacctcgctaatttttttttttttttttggtagagatgggggtttgccatgttgctcaggctggtctcaaactcctggactcaagcgatcggcctgccttggccttccaaagtactgggtttacaggtgtgagccaacaaacccagccaaaaaactgattttttgaaaagagaaaatcaataaaccattagctagactaaccaagaagacccaataaataaaatcagaaatgaaaaaggagacttacaatggacaccacagaaatacaaaagattattagagaccattatgaacaactatatgtcaacaattagaaaacctagaggaaagagataaattcctggacatatataacctcccaagattgaaccaggaagaaaaaaaatctgaacagagcaataacaaggaatgagattgtatcagtaataaagtctcccagtaaagaaaacctcaggattgcacgggttttctactgaattctaccaaacctttaaagaactaacatgaattcttctcagacaattccaaaagactgaagagaaaggaattctccctaactcattctgtgaggcaagcagtatcttgataccaaaaccagataaggacacaataacagcaaaaaagaaaactacaggccaatctccctgatgaacatagatgcagaatcctcagaaacaaaacacacacacagacacacaaactagcaatctgaatccaatcgcacatcaaaaagataatacaccataatcaagtgggatttatcccagggattcaaggatggttcaacatatacaaatcaataaatgtgatacatcacattaacagaaggaaggacaaaaaaatacatgatcatctcaatagatgcagaaaaagcatctgataaaattcaaaatctcttcatgataaaaaaaaaagctcatcacataatgtctagaaggaacataactcaatgaaggtcatatatgacaaacccacagccacctggggaaaagctaaacaccttctctcttagaactagaacaagacaaggatgcccactttcactattcttattcagcagagtaagaaaagtcctcaccagaacaattaggcaagtaaaagaaaaagggtatccaaattggaaaagagaatgtcatattgtcctttgcagatggcataatcttatacatagaaaaacctaaagattccaccaaaatcttttagaactggtaaaggaattcaataaagttgcaggataaaaaaatcaacaaacaaaaattagtaggtgtggacatgatggctcatgcttgtaatttcagcactttgaaaggatgaggcgggtggattgcttgagcccaggagtttgagactgtcctgggcaacatggcaaaacctcatcagtacaaaaatgagctgggcgtggtggcctgcacctgaagttcagctactcaggaggctgagatgggaggatcacttgaacctcggaggtgaaggttgcagtgagcagaaattgcaccattgcaccccagcctgggcaacagagtgagaccctgtctgcactcccctgcctcccccaaaaaatcagtagcatttctgtgaaacagcaaattagccaaaagagaaatgaagaaagcaatcccatttgcaatagctacaaaaaaaagcaaagcttaaccaaggaggtgaaagatttccacaatgaaaactataaaatactgataacagtaattgaagaggctacaaaattttttgagacatcccatgctcatggattgaaagaaaaatgttaaaatgatcatatttacctatagcaatatacagatgctatgaaatccctatccagatatcagcaggggcttcaagatggctgactagaggcatctggcactcacctcctccacaaaatatagcaagtaggtaaccacagtttatatagatcgcctctgagagaatgctggaattcaactgagaagtaataagaaaaacccaatgcaagggataagaggggagtcaggcagtctgcttctatgggactggctgggatcatgaagagactcctcgatgtgcagaaaggtaagtaagtgagcccctagtggtccacattcccacagcagactcctgaaatcctagtcagagaaccccctgacccatagatgccttgagactaacaagaggctacctacagactgtgaaatggcaatgaacagctcccagagagggagatcaccctgaatcctcaggcaattcacacatcccctgaatcctcaggcaacttcaggaaagtcccattttgatagcccaacccccaccagactgcatctgctgtgggccccacatccctctatctcatccctggagccccatggacatcccttacacaaagctggttgccactcctgactgctccctccaggccaaagcatgagccattggcaatactctgctacctccgaagcaaggctgccatgaggaaaggtgaccctgcccatagtcaccacctggggccgaagcatgcattgcccaactgcctgtttatagctgctgccactgaaagcaatcccactcaacttccccaggagtagggctgcaatagagttgctgctgccccaacatgagcattcagcagggtatacagggatcttcctgtgcctgcctaccacagtcagtacattcttgcattactggagggcctcaggacaggcccacctggcctggtcccaccctcttttctcccagtgccagcgcataccatctctgggcctagggatcaccctgccctatccagtattgttggcacctgagcactcctgggggcttgaggactgccctacccaactgaccattaccaccacaactggcattcacttgaatttgccacctgtgggccttgggacaagctcatccagcttatcccagccatcccaataccagcatggacaccttgggaggcagaagattgttctgccactgctactgccattgcccaagccatatctgctgctcagagctcaaggacctacccaccctgtggcccagctctgtcatcattggcacctgagcaagttgcctggaggcccaaaattggtttccctggacttgctaacactggtaccagcatacactaccattgggcccaaggataagcattcggggccagccactgctgccactggggcctgaggactggcccagctggtgtccctatccccagccagactttaccacagcctccaccaacaactgcatcctaaactacagaggaactcccagacactactggtgctgtttacagctgaaaaaaattccatggagatcacactactgcaggcacccagaatcaaaaccaaagtgccctgcccaaagaacaccatagatatatcttcaggaacaagactctcttaggaaagacagatcaaaaaattggaagaaactactgttacaccagatgtgcagataccagtgtaagcacacaagaaacatgaaaaggcaaaacatgacaactcctaaggaatgcaataattctccaacagattccagtgaaaaagaaattgatgaaaccttgaaaaattcaatataatattaaagaagatctgatagactatacaaagaaatcagaaaaaacaattcggggtatgaatgagaaatttgcccaagagatagatataaaaagaaccaaacagatattctggaattgaataatagattgaatgaaataaaaaacatatttgaaagcttcaataacagaccacaacaagcagaagaaagaatttcacaccttgaagataagtcttttgaaatgactcagacaaaaatatagaaaaaatagaaaagaatgaacaaaggctatgtgactataggatgccataaggtgacaccttcagtgtcccagaaggtgaagagcaaaccaaaagattataaaacctatttaatgaaataatacctgaacacttcccaatctcccaagagatttagatccaaatataggaatctcagaaccctaaatagatacaattcagaaaggtcttttccacagcacattatagcaaattgcccatcccaagacaaagagagaatcataaaaccagcgataaaagaggttgtagacacttacaagggaacaacctgcagactaacagatttttcagcagaaactttacaggccaggaggatgggattatatacgcagagtgctgaaagaaaaaacaaaaccaaaaacctgccagccaggaatactgtacttagcaaagttatattcgtcagaaatgaaggagaaataaagtatttcccttaaaagtaaaagctcagggaattaattgccactacactggcactacaaaaaatgcttaagggagtcttacaggaagaagtgaaaggacaacttcatgaaagcacacaaaataatcagaaatcaattaatgacaggaataagccctcacatatcaacaataaccttgcatataaatagattaaactttctacttaaaagacagactggctgaatggacttaaaaacatgacccatctaaatgctatctacaagaaacgcatctcacctgtaaagacacatagttgaaagaaaggaatgggaaaagatattacatgcaaaaggaaacaaaaaccaaacaggagtagctatactttcatcagataaaacaaaggttaagctaaaaacactaaaaagagacgaagtcattatatagtgacagagggatcaattgaccaagaggatataacaattctaaacatatatgcacccaacaccaaagcacccagatatataaggcaaacatcaaatctgaagggaaaggtagacttcaacacaataatcttgggaacttcaattctccatttccagtattagacagatcatctagacaaaaaattaacaaagaaacattggatttaaactgcactttataccaaatggacctaacagacatttacagaccagttcataaaacagctgcagaatatacactcttctcatcagtacatggaacactctccaggatacattatatgttaggacactaagtatgattttaaatatatatatattttaaattggattcatatcacatatcttctcagaccacaatagcataaaactataaataaataagaggagcattcaaaactgtataaataaatggaaattaacatgttcctgaatgaccaatgggtcaaagaagaaattaaggcagaaataaaaaatttactgaaacaagtgaaaatagaagcacaacattctgaaacttaagggatactgcaaaagcaatgctaagaggaaagtttattgtaataaatgcctccattaaaaaaggtagaaaagatcttaaataatctaatgatacacctgaaggaaccagaaaagcaagaacaaaccatactaaacataaaattagtagaaggaaagaaataacgaagatcagagcagaactaaacaagaaactaaataaatataaaggatcaatgaaatgcaaaatcggtttttgaaaagaaacaaaataaccagtggctaaactatccaagaagaaaagagagaagacctacatgaataaaatcaaaaatgaaaaaggggatattacaactcataccatgaaatacaaaaatcaaaactcttcagtctgatcaataaattgattacagttacaggatttaaaaatcaggcttatttctatataccaataaagaaccagctgagaaagaaatcaagaaggcattatcttttacaaccactacaaaaaatctaggaatgagtttaaccaaagaggtgagaaacctctaacaaggaaaactacaaaagtctgatgaaagaaattgaaaagaacacacaaaaaacatcccattctcatggattgggagaattaacaaaattaaaatgaccatactacccaaagcaatctacagattcaatgcagtctctctcaaaataccaatgccatttttcatggaaatagaaaaaatcctaaaattcagatggaaccaaaaaagagctggaatagccacagcaattctgagcaaaaataacaaagttggatgcatcacactgcctgatttaaaaatataaggctatagcattaaaagcagcatggtattggaataaaaactgatagaccaatggaacagagtagaacctggaagtaaatccatgtatttacagccaactgatttttgacaaagatgccaagaacatacactgggaaaagagcaccctcttcacttaatggagctgggaaaataagatatccatgtgaaaaatgaaaccgtttctatctcttgctatactaaaatcaactcaagatgggttaaagacttaaacatgaggcatgaaactataacatcactattaatgaaggagacattggggaaacactttaggacattggtctagggaaagattttatggataagacctcaaaaacacagacaaaaacaaaaatagacaaatgggactatattaaatgataaagcttgtacacaacaagggaaacaatcaccagagtgaagagacagcctgttgaatgggagaaaatatttgcaaactactcatctgacaaggtactaataccagaatatactaggaactccaataactcaatagtaaacaacaaattaattccaataaaaagtgagcaaaagacatggatagatatttctcaaaagaaaacatacaagtagccaacaggtatatttaaaaaaaaaagcccaacatcagtaattataagggaaatgcaagccaaaaccatagtgagaatggctattttaaaaagacaaaaattaaccaatgctggagaggatgtggagggaactcttatacactgttggtgggaatgtaaattaatactatagaaaacagtttgatttctgaaaaacctaaaaagagaaatatgacataatccagcaatctcactactggatatttatctaaaggaaaagatatcagtatactaaaaatgtacctgcatccccgtgtttattgcagcactattcacaacagcaaagatatggactcaggaacctaagtgtacatcagtggataaatggaaaaagaaaatgaggtaaatatatacaatggaatactaattgaccaaagaagaatgaaatcatgtcctttgcagcaacatgaatggagctggaggtcattattttaagccaggcacagaaagataattatcttatgttattatcatatgtgggagctataaaagttgatctcatggaggtagagagtagaaggatagataccaaaggctgtgaaaggtatgtctggagggtgaagagaggttggttagtgggtaaaaatacacagctagttagaataaataatttataatgtttgataagagttggttgactatatttaacaatataatgtatatttcaaaataaaaaagaggacttgaaatgttcctaactatagagatgataaattgagggtgatggataccctgacttgatcattacacattcgatgcatgtaacaatagcacatgtaccccataagtattatgtatcggtcaaaaaaaaaaaaaaaaggaaatcccagtgctttggggggccaaggcagaaggatcgcttgagcccaggaattcaagaccagcctgggcaacaatgcacgaccctgtctctacaaaaaattaagaagttatccaggcatggtggtgcatgcctgtagtcccagctacttgaggggtcaaggatggagaatgacttgagcctgggagttaaagattgcagtaagtggggtggttccaagatggccgaataggaggagctccagtctatagctcccagcgtgagtgacgcagaagatgggtgatttctgcatttccaactgaggtagtgggttcatctcactggggctcgtcaagacagtgggtacaggacagtgggtgcagcccactgagtgtgagacgaagtagggcgaggcatcgcctcacctgggaagcacaaggggtcagggaattccctttcctagccaacggaaggggtgacagacggcacctggaaaactggatcactcccaccctaatactgtgcttttccaatggtcttagcaaacggcacaccaggagattatatcccgcgcctggctcggagggtcccacgcccatggagcctcgctcattgctagcacagcagtctgagatcgaactgcaaggcggcagcgaggctgggggagcctgccattgctgaggcttgagtaggtaaacaaagtggccaggaagctcgaactgggtggagtccaccacagctcaaggaggcctgcctgcctctgtagactccacctctggggacagagcatagccgaacaaaaggcagcagaaacctctgcagacttaaatgtccctgtctcacagctttgaaaagagtagtggttctcccagcacggagtttgagatctaagaatggatagactgcctcctcaagtgggtccctgacccccgagtagcctaactgggaggcactccccagtaggggcagactgacacctcacacggctgggtactcctctgagacgaagcttccagaggaacaatcaggcagcaacatttggtgttcagcagtattcgctgttctgcagcctctgctgctgatacccaggcaaacagggtctggagtggacctccagcaaactccaacagacctgcagctgagggtcctgactgttagaaggaaaactaacaaacagaaaggacatccacaccaaaactccatctatacgtcaccatcatcaaagaccaaaggtagataaaaccacaaagatggggaaaaaacagcagaaaagcagaaaattctaaaactcagagcacctctccccatccaaaggaacgcagccactcgccagcaatggaacaaagctggacggagaatgactttgacaagttgagagaggaaggcttcagacaatcaaacttctccgagctaaaggaggaagttcgaacccaaagcaaagaagctaaaaaccttgaaaaaagattagacgaatggctaactagaataaccagtgtagagaagtccttaaatgacatgatggagcagaaaaccatggcacaagaactacgtgacaaatgcacaagcttcagtagccgatttgatcaactggaagaaaggatatcggtgattgaagatcaaatgaatgaaatgaagtgagaagagaagttcagagaaaaaagagtaaaaacaaacgaacaaagcctccaagaaatatgggactatgtgaaaagaccaaatctacatctgactggtgtacatgaaaatgacagggagaatggaaccaagttggaaaacactcttcaggatattatccaggagaacttccccaacctagcaaggcaggatattatccaggagaacttccccaacctagcaaggcaggccaacattcaaattcaggaaatacagagaatgccacaaagatactcctcaagaagagcaactccaagacacataattgtcagattcaccaaagttgaaatgaaggaaaaaatgttaagggcagccagagagaaaggttgggttacccacaaagggaaacccatcagactaacggcggatctctcagcagaaactctacaagccagaagagagtgggggccaatattcaacattcttaaagaaaagaattttcaacccagaatttcatatccagccaaactaagcttcataagtgaaggagaaataaaatcctttatagacaagcaaatgctgagagatgttataaccaccaggcctgccctacaagagctcctgaaggaagcactaaacatggaaaggaacaattggtaccagccactgcaaaaacatgacaaattgtaaagaccatagatgctaggaagaaactgcatcaactaacgagcaaaataaccagctaacatcataatggatcaaattcacacataacaatattaaccttaaatgtaaataggctaaaggctccaattaaaagacacagactggcaaattggataaagagtcaagacccatcagtgtgctgtattcaggagacccatctcacgtgcagagacacacataggctcaaaataaagggatggaggaagatctaccaagcaaatggaaaataaaaaaaggcaggggttgcaatcctagtctctgataaaacagactttaaaccaataaagatcaaaagagacaaggtcattacataatggtaaagggatcaattcaacaagaagagctaactatcttaaatatatatgcacccaatacaggagcacccagattcataaagcaagtccttagagatctacaaagagacagactcccacacaataataatgggagactttaacaccccactgttaacattagacaaatcaacaagaccggaagttaacaaggatatccaggaattgaactcagctctgcaccaagtggacctaatagacatctacagaacattccaacccaaatcaacagaatatacattcttctcagcatcacatcgcacttattccaaaattgaccacataattggaagtaaagcactcctcagcaaatgtaaaagaacagaaactataacaaactgtctctcagaccacagtgcaatcaaactagaactcaggattaagaaactcactcaaaaccgctcaacgacatggaaactgaaccacctgctcctgaatgactactgggtacataacgaaatgaaggcagagaaataaagatgttctttgaaaccaatgagaacaaagacacaacataccagaatctctgggacacatttaaagcagtgtgtagagggaaatttatagcactaaatgcccacaagagaaagcaggaaaaatctaaaattgatgccctaacatcacaattaaaagaactagagaagcaagagcaaacacattcaaaagctagcagaaggcaagaaataactaagatcagagaagaattgaaggagatagagacacaaaaaacccttcaaaaaatcaatgaatccaggaggtggtttttttgaaaagatcaacaaaattgataggcctctagcaagactaataaagaagagagaagaatcaaatagatgcaataaaaaatgataaaggggatatcaccaccgatcccacagaaatacaaactaccatcagagaatactataaacacctctatgcaaataaactagaaaatctagaagaaatggataaattcctggagacatacacccttccaagactaaaccaggaagaagttgaatccctgaaaagaccaataacaggctctgaaatttaggcaataattaatagtctaccaaccaaaaaaagtccaggaccagacggattcacagccgaattctaccagaggtacaaggaggagctggtactatgccttctgaaactattccaaacaatagaaaaagagggaatcctccctaactcattttatgaggccagcatcatcctgataccaaagcctggcagagacacaacaaaaaaagagaattttagaccaatatccctgatgaacattgatgcaaaaatcctcaataaaatactggcaaaccgaatccagcagcacatcaaaaagcttatccaccatgatcaagtgggcttcatccctgggatgcaaggctggttcaacatatgcaaatcaataaacattatccagcatataaacagaaccaaagacaaaaaccacatgattatctcaatagatgcagaaaaggcctttgacaaaattcaacagcccttcatgctaaaaactctcaataaattaggtattgatgggatgtatctcaaaataataagagctatttatgacaaacccacagccaatatcatactgaatgagcaaaaactggaagcattccctttgaaaactggcacaagacagggatgccctctctcaccactcctattcaacatagtgttggaagttctggccaaggcaatcaggcgggagaaagaaagaaaggatattcaattaggaaaagaggaagtcaaattgtccctgtttgcagatgacatgattgtatatttagaaaaccccatcatctcagcccaaaatctccttaagctgataagcaacttcaacaaagtctcaggatacaaaatcaatgtgcaaaacatcacaagcattcttatacaccaataacagacaaacagagagccaaatcatgagtgaactcccattcacaattgcttcaaagagaataaaatacctaggaatccaacttacaagggatgtgaaggacctcttcaaggagaagtacaaaccactgctgaacaaaataaaagaggatacaaacaaatggaagaacattccatgctcatggatagggagaatcagtatcatgaaaatggccatactgcccaaggtaatttataaattcaatgccatccccatcaagctaccaatgactttcttcacagaattggaaaaaaactactttaaagttcatatggaaccaaaaaagagcccgcattgccaagacaatcctaagccaaaagaacaaagctggaggcatcacgctacctgacttcaaactatactacaaggctacagtcaccaaaacagcatggtactggtaccaaaacagagatatagaccaatggaacagaacagagccctcagaaataataccacacatctacaatcatctgatctttgacaaagctgacagaaacaagaaatggggaaaggattccctatttaataaatggtgctgggaaaactggctagccatatgtagaaagctgaaactggatcccttccttacaccttatacaaaaattaattcaagatggattaaagacttacatgttagacctaaaaccgtaaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaactaccgtcagagtgaataggcaacctacagaatgggagaaattttttgcaatctactcatctgataaaaggctaatatccagaatctacaaagaactcaaacaaatttacaagaaaaaacaaacaaccctatcaaaaagtgggcaaaggttatgaacagacacttctcaaaagaagacatttatgcagccaaaagacacatgaaaaaatgctcatcatcactggccatcagagaaaggcaaatcaaaaaaccacaatgagataccatctcacaccagttagaatggcaatcattaaaaattcaggaaacaacaggtgctggagaagatgtggagaaataggaacgcttttacactgttggtgggactgtaaactagttcaaccattgtagaagacagtgtggtgattcctcaaggatctagaactagaaataccatttgatccagccatccccttactgggtatatacccaaaggactataagtcatgctgctataaagacacatgcacacgtatgtttattgcagcactattcacgatagcaaagacttggaaccaacccaaatgtccatcaatgatagactggattaagaaaatgtggcacatacacaccatggaatactatgcagccataaaaaaaggatgagttcacgtcctttgtagggacatggatgaagctggaaaccatcattctcagcaaactatagcaagaatgaaaaaccaaacaccgcatgttctcactcgtaggtgggaactgaacaatgagaacacttggacgtaggaaggggaacatcacccaccagggcctgttgtggggtggggggggaggggggaggggggagggaaagcattaggagatatacctaaggtaaatgacaaggtaatcagtgcagcacaccaacatggcacatgtatacatatgtaacaaacctgcacgttgtgcacatgtaccctagaacttaaagtataataaaaaaaagggagagagagagaaaagagaaatctaaaaaaaaaaaaataccaaagacaatcttcaccgaaatagcaaaaacacaatccttaaacttgcatggaaccacaaaagaccacaaataggacaaacaatactgagcaggcagaatgaagctggaggcactacactgcctgacatcaaaatacagtcgactcttcaacaacatagatttgaactgtataggttcatttatacgtggattttccccataatctaacaaggatagaatgcaatattcacaaaagtgaaaactatgtatacagatgactgacattttgtatatgcgcattacacagggctgactctgggacttgaatatacatggcttttggtatatacagggggtctcggaagcaatcccccttgtatacaaaacaatggtaaccaaattagcatgcaatgggcataaaacagacatatagaccaatggaacagaatagagaacccagaagtaaataaatttatttacagacaactggtttttgacaaaggtgccaagaacacactctggggaaaggacaccatgttgaacacatcatgttgggaaaacaggatatcatatgcagaagaatgaaactatactatctctcagcatataaaaaaatcaactcaaaattgattagagacttaaacatgagacctgaagcaaacagtactagaagaaaacagaagggaaacccttcaggatatgggtctagcgaagattttatgggtaagactttataagcacaggcaacaaaaacaaaaatagacaaatgggactgtatcaaactaaaaacctacacataaaaggaaataataaactattaagagatatcctgtagaatgggagaaaatattcatctgacaagggattaatatccggaatatacaaggaattcaaacaattcaacagcaaaaaacaccagattatctgatttagaaatgtgcaaaatagaacaactggccaacaggtatgtgaaaaaatgctcaacatctctcatcacagaaatgcaagtcaaagccacagtgagacattatttcacctcagttagaatggctgttttcaaaaagacaaaacataacaaatgctggcaaggatgcagagaaaagggaaataatacactatttgtgggactataaattagtgagtcattatggaaaatactgtggtgttttgtcaaaaaaactaaaagtagactatcatacagtttgacaatccactaccgggtattgactcaaaggaaaggaaatcagtatataaaaaagatatttgcattctcatgtttattgcagtactgttcacaacagttaagatatggaatcaacttaaatctccatcagcagatgcagagaaagaatgtggtatgtatacacaatggaatattattcagtcataataaagcattaagtcctgtcattcacagcaacatggatgaacttggataatatgttaaatgaaattaggcacagaaagatggaggattttgactgctcacaaaacagagaaatgatatttgagttgatgaatatgctaattaccctgatttgattatgacacattatatacatgtatcacaatatcactgtgtatatcccataaatatctacaattattacatgttgactaaaaataaaaggacaaagaaaaagactcctagaagaaaaacccacaaggagcatcataatggtgaaaagactaagagcttttcctctaagatcaggaataaagcaagatgcgcattttagccattatattaaacatagtagtggctttctagccaaagaatatggaaaagaaataaaggcatcatttagaaaggaagaattaaaattatgtttgttcatagatatgatcatatttgtagaaatccctgaaaactcaccacaaaaactgaataaattaattcagcaaagtagcaggatagtaagtcagtacacaaaattcagttgcatttctttttttttttttttttttttgaggcagagtcttggtctgtcgcccaggctagagtgtagtggcgcgatctcggctcactgcaagctctgcctcccgagttcacgccattctcctgcttcagcctcccaagtagctgggactacaggcacacgctgctatgcctggctaatgtttttgtatttttagtagagatggggtttcaccatgttagccaggatggtctcgatctcctgaccttgtgatctgccctcctcagcctcccaaagtgctgggattacaggcgtgagccactgcgcccagctttcagttgcatttctatacattaatcacaaacaatctgaaagggatattattaacacaactctatttacacgacagcatcaggacactcagccttggccaccaaggacctttgtaatgtttgccactgctgacctcagctgatggagctgcaagaagagtattccattatatcctcatctgggctacagctgctgcaccctacctacttaacactccatcaagtgagcagatttcaattcattgtaacaagaaacagaaaaaccaaggaaacatagcacccacctgagaaatacaataattttcagggactgactcccaagaaattgggatacattaattgccttacagaaaattaaaaacgactgatttaaggaagttcagtgtgctaccagagaacagagagacaacctaatgaaatcattaatacacaaaaggagacattcaataaagaaatagaaatcctaaaaaaaaaacaaacattttggaggtgaagaatatagtgcatgaaatgaaaagtgaaatagaaagcatcagcagcagacttgatcaaatagaaggaggaattcatcaactggaggataaattatttgaaaataaccagtagaggagaaaaataaagaatgaaaaggtaacaagggaagtttacaggatttatgggacaccatcaggagagttaatgttcacacaggatttatagaaggaaagtagagaggtaaagggtagaaagttaattcagagaaataatggctgaaaacttcccatatctggggctcttcccagattgatggacatctaggtacatgaagctcaaagaattacaattagtttccatctaaaagaggtttcacctagatatattgccatcaaaatgtaaaaaatggaagacaagataattttgaaagcggcaagataaataaagttcttacatctgcaggaacctccataaggctatcagtggatttctgagcaaaaactttccaggccaggaaacaataggattatatattcaaagttctgaaagataaaaaactgccatctaagaatactttacacagcaaagctgtccttcagatatgaaacagatacaagacttcctcaggtaaacaaaagttgaaggagtttatcagcaactactcttgccttacaagatatgccagagggagttattcaggcttaaatggaaggatgataattagtaacatgaaaacatatgaaagtacaaaattcactgataaataaatatacgggcaacttaagaatactctaatagtgtaatggtagtatataaatcacataactctagtataaaggttaaaagaaaaataattaaaaattactattgttttcataatttctcaatggatatgcaatattaaaaggtgtaccttggggcatcaaaaataaaatgtagcgggggaagtataagatcaaaatattccccccaaacaaagagggaacaatcccaacttattttacaaggctagcattgccctcatactaaggccagacaaggacaatataagaaaagaaaataactggctgatatttttttatgactatacatttaaaaattttcaacaaaatatgatcaaactgaatttaacagcacattaaaaaaatcatatatcacaaacatgggatttatccttagtacataaggacagttaagtgtacatatacaagaaatgggatactttaataaaatcaaagataaaaatcatacaatcattttgataagtgcaaataatgcagttcacataattcaacatccttccatgataaaaactatgaacaaattaggtatagaaggaatgtactgcaacacaataaaggccatatatgaatagcccacagctaacatcatactcaatgctgaaaagctgaatgcctctcctctaagatgaggaacaagaaaaagatattctcaccacttctattcaacacagtactggaagtcctagccagaggaattgggcaagaaaaataaataaatacactcaaatcagaaagaaggaagtaaaattgtctctgtttgcagatgacatcatatatgtagaaaatgctacagactccacaaaaaaaacctgttagaagtaataatctaactcagtaaagtggcaggatacaaaatcagcattcagaagtcatttgcgtatctatacactaataataaacaacctgaaaaacaaattaagaaaacaatttcatttaaaatagcatcaaaaagaatagagagctcccaaataaatcctttcatatatgaacgcatgatttctgacaagcatgccatgtccattcaatggcaaatggattctcttttcaacaaatggtgccaggaaaactggatatcctcacgtgagagaatgaagtcgagacctttacctaactccatatacaaaaattaactcaaagtggaccacagacctaaatgtaagacctaaaactataaaactcttagaagaaaacatggggcaaaaactgcatgacattggatttggtattgacttcatttggatataatatgaaaggcacagataaaataaaaaatagagaaattggactgcataacatttaggcatacatttaaccaaggagataaaagacctagacactgaaaactatgaaacattgaacaaattctaagatgatacaaataaatggaaagatatctggtgttcatagatcaatagaataaatattgccgaaatagctatactactcaaagtgatctacagattcaaggcaatgcctatcaaatttccagtgactttttttcacagatatagacaaaaaaaatcctaaaatttgaaagaaactacaaaagaccttaaagatctaaagcatacttgagcaataagaacaaagtgaaagatattacacatgcttattttgaattatatttcaaagttatggtactggtatagaaataaaccaatggaacagaatagaaagcatagaaataaacccacacatttatggtcaactaatctttgacaaagacaccaagagtacacaatggggaaagggtactctcttgaataaatggcactgtgaaaccaggatatccacatgcaaaaaaattaaattggaaccttaccctacactgtagagaaaagtgaataagatttaaacatatgacctgaaaccataaaacctataaaacagggaaaagctccttgccattggtttttgtgacaattttttagatgtgacatcaaaagcacaaggaataaaacgcaaaaataaattagaactacatcaaacaaaaaagtgtctgcacaacaaaggaaacaacaaaatgaaaaggcagcacatgtagcgggagaaaatatttccaaccatatatctgataagctattaatatccaatatatataaggaactcatataactagcaaaaaaacttaataacccaattaataacctgttaagatggacaagggactgaatagacatttattcaaagaagacatacagatggtcaacaggtatataaaaaggtgcttaacatcacttatcatcagggaaatgcaaatgaaaaccacactgagatatcacctcataactgttagaatcgctattatcaaaaagtcaaaagatagcaagtgttggtgaggatgtggagaaaaggtgtcccttatacatttttgttaggaatgtaaattgatacagtcattatggaaaacacgatagattttctttaaaaaattaaaattggaactgctatatgatccagcagtctcagttccgggtatatctaaggaaaacaaagtcagtatcttgaagaggtatctgcactcccatgttcattgtagtgttacagtagtcaagaaatgagcaacatagtattcataggcatggtggcttgtacctgtaatcccagtacttgggggtggccaaggtgaaggatagcttgaacacaggagtttgagaccagcctaggaaacatagtgataccctatctctacataaaattttaaaaattagctgggcatgggggtgcatgactgtggtcccagctactcaggaggctgaggcaggaggatcacttgagcccatgaggttgaggctacagtgaactgtgattgtgccactgtactcctgcctggatgacagatggagaccctgtctcaaaaagaaaggaagaaaatagtgtgtgtgtgtgtatcaccaaattcccaaataaacacatcacatacatatacatacagacacacacacacacatatatacacacacacaatgaaatattcatcctttaaaaagcaggaaatcatgcaatttatgacaacatagatgaacctggaggatattatgctaagtgaaatagccagacacagaaagacaaatactgcactatcccagttacatatggaattctaaaaagcttgaactcagagaaacggagagtagaagggtggttactaggggtcagggagtaggggaaataggaaatgttgaagggtacaaacatagagttatcagatgaataagttcttgacataacgtccagattggtgactatagttaatatattctatacttggaatttgctaagagagtatagcttaggtattctgaccacacacacgcacacacatggcaactatgtaaggtatatgttaattggcttgattgtagtaatcatttcacagtaggtcaaatatgttcttaaatatatgcacttttaatttgtcaattatacctcaataaaagctgaaaaaagcatcaagaataacaaacttaggaaccaactttaccaaggaggtgaaagtcttgtacaatgaaaattacaaaacaatgctgaaagaaattaaagtagacataaagggaaaacacctcctatgttcatggattggaaggccaatattgttaaggtgtcagtaccacacaaaacaatctacaaatccaaggtaatcccaataaaaatcctaatgatgttatttgcagaaagaagaaaccccatcctaaaattcacatggaatctcaagggaccttgaatagctaaaacattcttgaaaatgatgaacaacattggaggactcacactttctgatttgaaaacttactacaggccaggtacaatggcctacacctgtaatctcagcacttttgaaggctgaggtgggaggacttctgagtccaggagtttgagaccagcctggggaacacagggagacctcatctctacaaaaaataaaataattggccaggtgtaatggtacacacttctattcccagctactcaagaagccgaggtgggaggattgcttgagcctgggagattgaggtggcagtaagcagtgataatgccactgtactccagcgtgggcaacagagtaagaatgtctgaaaaacaaacaaaaaccccaacttattacgaagctacagtaatcaaaactatgtggtattgacataaagatgtagagaccaatggaattgaatagagagcccaaaaataaacccttgtatacatgatcaaatgattcctgagaagagtgccaagaccattcaatagggaaagtgctgtattttcaacaaatggtgccaggataactgaagttgagacccttacctaataccatacacaaaaattaactcaagagaatgaagttgagatccttacctaaccatgtataaaagagaatgaagttgagacccttacctaacactgtgtacaaaaacttactcaaaatgggtcaaagtcctaaaactatgaagtcttataaggaaacataggggaaaaactttacatcattggcagtgcttcttgtatgcgacaccaaaggcacaggcaataaaagtaaaaatagataaattgtacttgcacaggcaataaaagtaaaactagataaattttaaaaatttacattgtgtgcattaaaataatatcaactaagcaataagacaacctacagaatgggagaaaaatttgcaaatcacatacctgataagggattaatgtccagattatacagagaacttctaaaagtcatcaccaaaaaacaatgcacctgaaaaatgggcaaaagggccaggcacggtggctcacgcctgtaatcccagtactttgggaggctgaggcgggaggatcatgaagtcaggagattgagaccatcctggctaacagggtgaaaccccgtctctactaaaaatacaaaaaattagccaggcgtggtggtgggcgcctgtagtcccagctactcgggaggcaggagaatgatgtgaacccaggaggcagaggttgcagtaagccgagatggcaccactgcactcagcttgggcaacagagtgagactccatctcaaaaaaaaaaaaaaaagggcaaaggacttggacagacgtatctccaaagaagatatacaaatggataatagtacgtgaaaagttgtttaacatctctagtcattaggaaatacaagtcaaaaccacaaccttacatacactcagatgactactattaaaaaaataaacacagcctaggcaacatagtgagacccatctctagtatcagctacgtgggaggttaaggtgggaggatagcctaagcccagaggtctaggttgaggctgcagtgtgccatgatcatgccactgcattccagcctaagtgacagagccagatcttgtctcaaaaaaatcccacataaacagaaaataaccactgctggaagggacatggagaaattggaatccttgtgcactgttagtgggaatgcaaaatggtacagcctctgtgttaaacagtttggtgttccttcaaaaattaaaaacagaattatctgatccatcaactccacctctgtgtatacacccagaaggattaaaagcagtctcaaagatatatttgtatacccacgattgtagtggcattatttacaacagttaaaacatcaatgcaacccaaatgtccatggaagaatggataagcaaaatgtggtatatacatacaatgtaatattattcagctttaaaaaaaatagaaattttgacacatgccacaacatggatgaacctcgaggccattatgttaaatgaaatacagcagtcacaagaagagaagtactgtatgtttccacttatatgaggtatgtagaatagtcaaatcagagacatagaaagtacaaggtggtttccaagagatggcggtggtgggggggttggggaattattgtttaatggatatagagtttcataattacaaatgacaagtgttatggagatggatgatagtgatgattgcacagcattgtgaacgtatctaatacattcactgaattgtacactaaaattggttaggatggtaatttttatgttaagtgtattttgccacaataaaagatttggaaatcaacaacaaatagaaatcccagaagataacataggaagaaatctagatgatctttagtttggtgatggctttttagatatgacaccaaaggcatgattcatgaaagaaataattgataagctagactttgttaaaaataaaagtttctgctctgtaaaacatactgtcaagaggatgaaaggacaggccacagaagggagacaatacttgtaaaagatatacctgataaaggactcatccaaaatatataaagaaccttaaaaacataacaattagaaaacaaacaatctgattacaaaatggactgaagaccttaacagacatctcaccaatgaagatatacagatggcaactaagtatatgaaaagatgccccacatcttacgtcattagggaaatggaaattaaaacaagaaatgtgatatatctacacgcttattagaatggccaaaattcaaaacactgacaataccaaatacttgccaatatgtggggcaacaggaacactcatccattgctggtgggaatgcaaaatggtacagccactttgacatataccattaatgggaatgtaaagtggtgcagccctggtggagaagagtttggtggttcttcaaagaattaaaaatggaattatcataggatccatcaattccacttctgaatgtgtatacatatcccccgaagaatccagagtatatcgaaatcagtggtttcttataaaattaaacatattcttaccatgcagttcagcaatcacatccttggtatttactcaaaggaggtgaagacttatattcacataaaaatctgcacagagatgtttacagaagctttatttgtgattgttgaaattggaagcaaccgagatgtccttccataggtgagtagacagataaactgtagtacatccaggcaatgaaatattattcatcactaaatagaaatgagctatcaagccatgaaaagatatggaggtaattaaaaaacatattactatgtgaaataaggcaatctgaagaaactacatactgtatgattccaatcatattgcattttagaaaaggcaatgctatggaggcagtaaaaagttcagtggttgccaagggttgttggggaagaagggttgaataggcagtgcacagagtacttttagggcagtgaaaatgtacaaatatatgtaaatatacgtatctgtatgatactataatggtagatacatgcatattagtccgttctcacagtgctataaagaactacctgagactgggtaatttgtgagaaaagaggtttaattgactcacagttttgtaggctgtacagtaagcatggctggcaggcctcagaaacttaaaatcatggcggaaggcaaaggagaagcaggcacatctttaccatggcagaacaggagagggaaagaaagtgagatgggaagtgccacacacgtttaaacaaccagatctcatgagaactcactatcatgagaacagcaagggggaagtttgccccccaccaggcccctcccctgacacatggggattacagttcaagatgagatttgggtgggaacacagagccaaaccatatcaacatgttacacatttgtagaaacccacagaatgtacaccccaacagtgagccctaatgttaactagggactttgataataatgtgtaaatgcagattcataagttgtaacaaacgtgccactctggtgggagagttggtaatgggaaaagctctgtatgtatgggtgcagtgggtatacgggaaatctctgtacttacctctcaattttgctggaaccctaaaactgctctaaaaatataaagtctttaaaatacacatacacacatacagacaatcgaatagagaatcataatggtacactatcagaaaatcatcaaacacaaaaaaaggcagtaagggaggaaatgttgtatttaaaaaatgtaaggcaaaagaaaaggcacaaaatgtcagaacttcttttttataagtaagtactttaaatgtaagtcgattaaattctccaaaaagcagaggttggcagaatggatttaaaagaaaaccatcaacctatgctgtatataacaaactcacttttggtctaaagacacaagtagattgaaagtgaaagaatgaaaaatgatatttcatacaaatagtaacctaaagaaagctggaggtaattatactaataaaagaaataaacttgaatttaaaaattgttataggagacaaaggaggacattacatactgagaaaatggaaaattactcaagacttcgcaattggaaacgtatacacaccaaaatatagagccccagaatataagaaaatatactgacagaattggagtgagaaagacagttctacaataatacttagggacttcaataacgtactttcagtaatgggtagagtcaaagaagaaatgaaaacagaaacttaaaaatatcttcagacaaatgacagtgggaacacaacataccaaaagcaaaacatgcagcaaaagcagttctaagagggaagtttacagcaataaatgccttgcctacattaaaaaagaagagatatttcaaatagcccaaaattgtacctcaaggaattagaaaaagaagaacaaactaaagccaaagttaacagaaggaaataataaagatcagaacagagacaagttagaaagaaaaaccataggggaaaaaagtcagtaaaactaagacttcaatttttgaaacaaagaattgatttttgaaaaataaaatcaacaaactcttggactaagaaagaggacaaaatcagaaatgaaaatggagaatatattacaacaggtacttcagaaataaaaaggatcataagggacttttatgaacaattatatcccaacaaattggataacctagaggaaatggacaaattcctagaaaaaaaccaacctgctaagattaaatcaggaatagaaagcctgaacagaccaatagcaaagagatcacagtggtaaactaaagagcttctgcatagcaaaagaaattatcaacagagtaaacagacaacatatagaatgggagaaaaaatatttgcaaactattcatctggcaaaggtcctatgtccagaatccataaggaacttaaaccaatcaacaagcaaaaaacgaataatccaattgaattggcaaaggacaggaacatacatttcttaaaagaaaatacagaagtagccaaacaaaaaaacattctcatgatcactaataatcagaaatgcaaataatgaggccaggcacggtggctcatgcctgtagtcctagcactttgggaggctgaggtgcgtggatcatctggggtcaggtattcgagaccatcctggccaacatggtgaaaccccgtctctactaaaaacacaaaaattagccaggtatggtggcggtcacctgtaatcccagctactcaggagtctgagacaggagaattgcttgaacccaggaggtggaggttgcagtgagccgagattgcgccactgcactccagcctgggagacagagcaagactctttctcaaaaaacaaacaaacaaacaaaaaagcaaaaaacagacaaaaaaaaacaaaacaaaacaacaacaacaaaaaaacaccaaaccataatgggatgccatctcacaccagtcagaatggcaattattaaaaagtcaaaaaaataaaagttgctgggaaggctgcagagaaaagggaacgcttatacactgttggcaggaatacaaattagttcagccactgtgctaagcagtttggagttttctcaaataactgaaaacagaactaccatctgacccagcaatcccattactggatatatattcaaaggaaaataaattgttctatcaaaaagacacatgcatttgtatgttcatcacagcactattcacaacagcaaagacatggaatccacttagatgcccatcagtggtggattggataaagaaaatgtggtacatgtacaccatggaatactatgcagccataaaaatgaatgaattcggccaggtgcggtagctctcacctgtaatcccagcactttgggaggccaaggcgggtggatcacctgaggtcaggagttcgagaccagcctgaccaacatggaaaaaccctgtctctactaaaactacaaaattagctggacgtggtggcgcatgcctctaatcccagctactcaggaggctgaggcaggagaatcacttgaacccggtaggcggaggctgcagtgagccgagatcatgccattgccctccagcctgggcaacaagagcgaaactccgtctaaaaaaaaaataaaaaaaaaaaatatatatatatacatgaatgaacttacgtcctttgcagcaacatggatgcagctagaggccactatcttaagcaaattaatgcaggaacagaaaaccaaatactgcatgttaccacttgcaagtgggacctaaacactgagtaaacatggacataaagatgatcagtagacactggggactacttgggggaggaatggagaggtgggctgaaaacctacctattgggtactatgctcactacctgggtgataggcttatccacactccaaacctcatcatcatgcagtatactccatataccatgcaacatatagacctgtacatataccctctaaatcaaaaataaaagttaaaaaaaccccaaaacctcaaacaaagaaaagcccaggaccagatagcttcatgactgaatactacccaatattcaaagaataccaatacttcttaaactcttccaaaaaaatgcagctatagggaatacttccaaaaaaaaaaaaatgcagctaaagggaatacttcctaacacattttatgaggccagcatcaccttgatacccaggtgagccaaaggcatcacaagaaaaggaaactacaggccaacataacccaagaataccgatgcaaaaatccttaataaaatattggcagactaaatttaacaatacatcaaaaagattatatatcatgtctatgtggaattaatttctggcatgcaaatcttatttaatatacatgtagcaatcaatgtgatactaacagactgaaagatgaaaaccacatgatcatctcaattgacacacaaaaagtatttgatgaagttgaacatcctttgttgataaattctaacagttcaggtatagaaggaacactcctcaatataacgaatgccatttatgaaaagcccacagctaacgttataatcaatgagggaaaacagaagcccttctactatgaaccagtacaaggcaaggatgcccactctagctactactactcaacatagtactggaagtactagtacaaccaaacagacaagaaaaagaaatgaaagacattcaaatcaggaagtaagaagtaatattatctttatatgaagatgacatgatcctacatatagaaaaccccgaagactctgacaaagcaacctgttagaactaataaatgagttcagtaaagttgtaggatataaaatcaatataaaacagtagttgcatttctatacacaaataatgacctggccaaaaaagaaatcaagaaaacaatcccatttatgatagcatcaaaaaaattgcttaggaataaatttagccaaaaagatgaaagacctgtacactgaaaactatgaatcattgatgaaagaaattaaacaagatacaaataaatggaaagatatcccatgctcatgaatctgaataatattgttaaaatgtcaataatatccaaatcaatatacagattgaataaaatccctatcaaaatcccatggaaaatttttttaaattctaaagttcatttggaatagcaagaaccttaagtagccaacgaaattctgaaaattctgttctgaaaaacaaagggagacttcatactttctggtttattttacaaaactattgatcaaacagtatggtcctggcataaaaaacaaacatgtagaccagtggaacagaatagagagcccagaaagaaattcaaagatatatgatcaaccaattttccacaagaacacgaagaaaacaatgcagaaagatagtctctctcataaatgacgttaggaaacccagttctgtggcttgtccaacccatggcccacagaccacatgtaagcccaggatggctttaatgaggcccaacacaaatttgtaaactttgttaaaacattgaatttttttgcatttttttagcccatcagctgttgttattgttagtgtattttatgtgtggcctaagacaattgttcttacagtgtggccccgggaagccaaaagatttgatatcgctgccttacaccatacatagaaataaactcaaaatggataaaagacctaaacataagaccaaaacccacaaccagaagaaaacataggggaaaagctcgacatggctctggcagtgattttttggagatcacaccaaaagctcaggctacaaaaacaaataattggtataccatcaaactaaaaaacttctgcacaggaacggaaacagtcaacaaaaggaaaaggcaacctatggactagaagaaaatatttgccaaccatatatcttataagaggataatatccaaaatttataaggaatgcatacaactcaataacaagaaaatagataacccaattaaaaaatgggcagtggaactgagtagacatttttgcaaagaagttataaaaatggcaaacacatatatgaaaagacatttaacatcactaatcgtcagggaaatgcaaatcaaaattactatgcgatatcacctcacactcatgagaatagctattaagtgttggctagggttagggaactcttgtacagtgttggtgggactgtagattggtgcagtcataatgaaaaacagaatggtggctcctaaagaaattgaaaatatactatcatctgacccactaatccctcttctaggtatattcccaaagaaaatgaaatctccacctcataaagatatctgcgctcctatattcattgtggcattatatgcatgagtcacgatatgaaaacttacgtgtccattgatggatgactaaactgtggtgtgtatgtctacaatggaatattattccgcattaaaaaaggagatcctgccacttgccacatggatgaaactggaagacattgtgctaagttaaataagccatatacaaatgaaaagttttaaataatctcacctatatgtagaatcttaaaaagaaaaaagtcaaatatacagagatagaataaactagtggttaccatgggcaaggtgtgggggaagaaaatggaaagatgtaggtcaaaggataccaagtagcagatatataggatgaacaagtctagagatctcatgtagaacatgagaatagttagtatattgcatttggaatttttgccaattgagtagatcatagcttttctcactcatacacacaaaagaataactgtgagatgatggacatattaatttgcatcactatgttaacgatttaactgtatgttttatacactaaatatgcatatttttaaaattaaaaaaaaaaaacacaacaagataatgtacagccagacagaagcccaataagaaaagagaggacttgaacaataccataaaccaactagacctacaaacatatatggacactccacccaactacacattcttctcaagtgcacatggaacattccctaggagggatgatatgttaggccacaaaagagtctcaataaattttaaaatatagaaatcatacaaaatatcttctctaactacaatatagtgaggccagaaatctgtaacagaagaaaaacctaaaaattaacaaattcagggaaataaaactacacactctttaaaaattattgtgtcaaagaagacatcagaagggaaattataaaatactttcaaaaagtgaaaatgacgacacaacatactcagacttatgggatgtagtgaaagaagtgctcagaggaaaaattatagctgtgaatgcccacactgaaaaagaagaaggatccataacctaatattataccttacgtaaccagagaaagaagaacgaagtaaacctaaagttaaaagagagaatgaaataatatgtatgagtggagataaaactgaattcgagcttaaataaacaacagagataatttaacaaaaccaaaagttgcttgtttttgaaaagatcaaagttgaaaacctttaactagaatgactaataaaaaattagagaagttgcacatatctaaaatcataaacaaaagtaggaacacaacaaaaaaaaacaaaaataagaaaaaaaaacaaaagtgggaacgatataactgatcttacagaaataaaaagtgtgataaaagaatactatgaataactgtataccaacaaattatataacctagataagatggacgaattcacaaaatactaatacagaccaaaacagaaattgaaattatgagcagacccataacaagtagaaagtttgaatcagtaaccaaaaaccttccaatgaagaaaatgctacacagatggcgtcactgttgaattataccaaacacttgaagaattcacaccaatccctctcaaactcttccaaaaaacagaggagaaaaaactttgcaatacattctatgaggccagtattacatggattccaaagccagacaaatataccacaagaaaagacaaactagatactaaaatcttttatttaacaaagtactagtaagccaaattcagcagcatattaaaaaggattatatatcatgaccacatggaatttatctcaagaatacaagggtggttcagtacaagagtatcaatcaatgtaatacaccacattaatacaatgaaggataaaaaatccatgcaatcatttcaattcactcagaacaagcatttgacaaaattctacaacctttcaggataaaaacatggaactttcaaaatgtgttaaagaggatttgtgaaaaatccacaactaatatacttaatgagaaaaaaaactgaaaaatttctcccataacaaagagtaagatatggctgtatgctttacccagtgctattgaacaatgtactgaaagttttaaccatgacaattaggcagataaataaacaaacaggtaaatgaatagcatccaaattggaaaggaagcagtaaaactctttattcaataatgacatcttctatctagaaaatcaaagaatccacaaactagtagagctaataaacaagtccagcaaaattgcagggtacatgttcaacatttattttaagaaaatcatttgtgcctctatataccaggaatgaacagcccaagaaggaagtcaatttttaaaattccacttacaatagcatcaaaaagagtaaaatagctaggaataaattaaaacaagaaggtgaaagacttctgcactaaagactacaaaacactgttgacaaaaattaaagaagacttaaataaatagaactatacatcctgtgttcacagattggaagattaaatattgttaagttggcgatattacccagtgatctacagattcaatgcaacccttatcaaaatcccaagggcctttttatttgcagaaatgtaaaaactgattttaaaatgtaaatggaattttcccagggccccaaacaatctaaaatcatattgaaaaagaacaaagttggaagactcaggcctgccattttcaaaacttttacaaagctgcagtaatcaaaacaatgtggtactgacacaatgtggtctctaggacacaaggatggacatatagaccaatggaatataatagagaatgtagaaataaacactcacatatatgatcaattcattttcaacaaatgtatcaagaattcagtgggaagagtagtcttttaacaaatggtgctggggcaactggatcctcatatatcaaagaatgaagttggacccataactcatagcatataaaaattatctcaaaatgtatcagagaccaaaaaataagagttaaaggcataaatttcttagtagaaaacaggagtaaatctttatgacttgagattggaaataaattcttagaaaagacacaaaaaacacaatattgtaaatgtactaagtgacactgaattgtacattttgaaatggtttctgttacttaaaaaatttaaagggtgcacagaagactaaaaagcagcacagacagaattatcaccagaaaaagaagactctatattaaatgtcaacatggagaacacatgtcagaaataggtagtccagagcagcagctatagtggaggctcttgcaaatgactaagatttgaggtggcaccctcagagaatcacctcttgggggtagattcgatttatggagtagatgtatctcagagacatggtaggaaagccaaagaatggtgagcatagctgccatctagaaaccacctacacatgcaagcataagagattggttgaaaggttatagcacagtcacactaaggaatactatgcaactttagcaatgcaatgagaaagatctctgtgaatggatgttgagtgatttctaggagatgttgttaggtgagaaaagcaaagttcaaaagggcatatacagaatagtacttttttgggaaatgagaaaataatcatgtcttataaagagcaaacacacacaaactataaactagaaaacactgaaactggttacctataatgggtagggggaattaggatggaagagatatgggtgagaggaagatttctctcagtagctccttttgtttagtattgacttttggaagtatgttaatgttatatgtattcaaaaaataaaattaacaagatagggaccacttctgaggtggtggaatgagcaccttgatataaccactccctgaaaagcaatgataaaactggacaaagaaatataaaattgaaaagtgctaattaaagaaaaaatattaagccttcctaagaatagcagggttatgatttaacgtggggctgccatctccccacccaagctcaggggcacggtaggcttgaggaccagcaacaaagaaggctcatctgattttgaattccatagaaaaccctatgcactatgttaagcaacaaggatttcagtggcaaataattggaggcaacccacatcacagcaacctaatgtttcaatactggttgggcaagcgacagattaagaaaaattttaaaaggaattctggagatatggaagttgtacatgcttgcaggagagatcagagaggtttcctgctatctacttatccttggctgactgtgagaccttttgcaagcagacagtaaaatacaggacagagttataaagtgcctgaactttgaatgtcccaacccacacatagatcccctcagcagagggtggaagattcactggctcaagatgtttaaacaaatgtctgactaatcatggcttgaccactaggttatgctgatccaggggtgacaccaatgaagccaggcttacaaaacaaacataagaattaaaacaaacaaaactgagcaaagacaccagtggctgcacactgcaggagaacacagactctgcagaatccatgcagagaaggcatacacaagcgagcaaacaaataaatgagtaacagaaatcatccctggttagggagaagaactagaatccagagtttctacgatatattatctaaagtaagtttttaacaaaaaaaatgagatatgcaaagaaacagaaaattgtgacccttgaacaagaataatgagcaataaataggaattatctctgaagggccccaaatgttagggcgcgatttcaaagtaagtattataactatgttcaaagaaccaaaagaaaccacattaaagaatgcaagtgtgatgacaaagactcatcaaatagataatatcaatatagagatagaaattagaaaccaaatagaaattctgtagttgtgaaatataataacttaggtgaaaaactcactagtgcggctaagcaaatttgacctggcagaagaaagaatcaatgaacttcaacgcagatccataaagatgattcagactgaagaatagaaagaaaaataatgaagaaaaatgaagagatacccattggataccataatatagtggtccccaacctttttggcatgagggaccagttttgtggaagacaatttttccacagccagttgggggaggctttagttagattctcatacggagtgcacaacctagatccctcacatgctcagttcacaataggatttgctctctgtgagaatctaatgccatcactgatcagacaggaggcagagctcaggcagtaatgcttgcttgcctgctgctcacctcctgctgtgtagcccagtttctaataggccacagactggtaccagtccatggccctggggttgggaacccctgtcctaacaggatgtgtaacaatgtatgtgtaattaagttgtaacatatatgtaattaagagtagaaaacatatgtggaattaaggagtaacaacatatgtgttaataagagtactgagaaggagagaatagggcagacaaaaatatttgagtagattattaacctgaagcagattgtttttgcttaagctgcttattgtaacctccagattacactttaaaaatgggggaaataaactaacaaaggaattagaatggtactctagaacatatctattcaacctgcagaaggcagtaaaggaggaagagaggaacaaaagtgatatgagacatatagaaaataaataacaacatggtagatataaatccttccatatcaataattatattacatataagtgaattaaaaactcaataaagagcagagattgccagactgccttaaaagcaggatccaaatatatatggtctataagagtcacattctagattcaaagacatagttgaaagtaaaatgatggaaaaagatgacatgcaaacagtaataagaaagctagagtgactgtactaaaatcagacaaaattggctgggtgcagtggctcacacctgtaatcccagcattttgggaggctgaggcagacagatcactcgaggtcaggagttcaagaccagcctggtcaacatggtgaaactctgtctctactaaaaattagctgggtatggtggcaaatgcctgtagtcccagctacttgggatgctgaggcaagagaacggcttgaatccgggaggcagaggttgcagtgagccaaggtcacgccactgcactccagcctgggcaacagagtgagactccatcccaaaaataaaataaaaataaataaaatcagacaaaatagactttaaaaacaaaccatgttattagagatactgagaagcattttacaatgacaaaagggaaaatttaacaggaagaaatagaaatcataaacagaagtcataaagaaataaaaatttataacagctaaaaacacagccctgaagtatatgaaataaaactgtcagaaatgaagagagaaacagacaactgaacaataatagacaactcaacaataatagtactaactcttgttgattttctgtcttgttgttctatcaattattcagagtgagttattgaactattacccaactactattcttggatgaaatggtgggaggtgaggctatgtggcactctgcttaataccctcccctgttctggtgtcagggagacaaatgtggagctgacttttcgtcagaaacagtggtacccagaaagtagtggggtaacagatcccaagtgctcaaagtaaaaaaaaaaaaaaaaaaaaaaaaaaaaagccaaccaagaatactgtgtccagaaaagtttctttcaaaaagaaggcaaaataaaagcattcccagataaacaaaaacagaattccttgttagcagaccagttttgtaagaactactagaggaagttcttcaggcaaaaaggaagtgctcccaggaagttcacatatatccaaaagcaaagagcaaggaggtaaataggagcaaagctgttctagagtaaggaaataccaccagttggtaactcaaatccataaaaaccaaaaaagtggatcaaatatatgatataaggaggttaataaaacagaaactagaaatatatacttgctctcctttcagcttctttaaagatatatcattatatagtatgatcattataatagcgcataataaagatgtaatatatgtaacaataccacaaaaagtggtaaaactgaataaactcatacaggaataacttctgtatctcaccaggattaatataaatatgaagtaaattttgagacgatacataaggtaagccctagagcaaacactaataacaaatagaatattgaagaatcataaaagaaatgaaaatttatattagaaagtagtcactagatggaaaagaaagcagcaaaggagaaatagaggaacaagaaatagtacatagaaaagaccaaaagtaaaactgtggatataaatctaattatatcaataataatattaaatgtgaatggattaaacaatctaatcaaaggcaggaattatcagaccagatttgaaaaacaggatccatctgtattccatctatatgaggcacactttagatgataaatgccaactgaaagtaaaaggatggaaaaagatatatcatgtaagcagcaaccataagtaacctgaagtgctataataaagtcaaaggagattttaaattaagaatgttactgaagttaaatatgaatatctcataatgataaaatgtcaattcatgagaagatacaatgattataaacatatattcacctaacaatagagaactaaaacataagaagcaaaaactgacagaactgaacagagaaatagccaattcaacaatagtagttggagacttcaacactccactttcaataatgtgtagtacaagaaagaagatcaataaggaaacagaagatatgagcaacaccataaaccaactagactcaaaaggtaattatagagcacttcgcccaacaaccaacattgaatatacagtattttcaagtgcacatgagacattctccaagaaggaccatatgctaagtcacgaaacaaacctgcataaatttaaaaggattgaaataatacaaggtatctttttctgaatataatgaaataaaagtagaactcagtagcaaagaaattagggaaacatacacatgtggaaattaaacaacactacattcttaaataatcaatgggtgaaagaattcacaagggaaatggaacgtactttgagattaatgaaaatgaagatacaacataacagaacttatgggatacatttaaagcagtgtaaagatggaattttatagctatgaatgcctatatcaaaaaataaggcttcaaatcagtaagccaactctccacctcaagaaactagaaaaagaagagcaaactaaacctaaagcaagtagaaaaaacaaaataataaatattagagtagaaataaaatatagaatataaaaataataaagtcaacaaatccaaaatttggttctttgaaattaacaaacctttgatagattggtaagagagagggagagggagaagaaaagaaggggaggaagaaagagggggaggaggaaagacagagagggaagtgcatgaggcaaagggggagagagaaaactcaaattactaaaatcagaaatgaatgacagttttacaaattaaagcaaaaaaacgaggctagctgcagtggctcacacctgtaatcccagcactttgggaggccaaggcaggagaattgcttgtggccaggagttcgagaattgcttgtggccaggagttcaagaatagcatgcacaacaaagcaagaccctatctctacaaaatattttttgaataacagctggtgttgtggtgcacacctgtcataggctaaggggcaaggatcacttgagactaggagatcgaggttacagtgagctatgattacaccactctattccagcctgggcaacagagagagactctgtttctcaaaaagaaaaggaaaaaggaatgaatgagggaagtatactaccaacctgacagaaataaaaaggattatgaaggaacactatgaacaattttgtgccaataaattataaaacttagatgaaattgacaaattcctagaaagatgaaaactatgaaaactgacta

SEQ ID NO: 251 - DNA, 2341 bp, Homo sapiens
agaccggccgacgcgggccaccccgctctcctcgccgccgcggcggcaggcgcggggccgcgccgcgaggcctgatccctgcagcgcgggcaggcggcgtcgcagagcggagctagctggatgcgtccggactcctgcaggtgagagtgattttccagtgattgctttggcctgtacaaccagagaacaggattcttcccttctttttggccaccaaatgcctatgtgcaccacacattccagtgtgctgagaagggcagagcttcttggatgatgatggacgtcccaccgggcaggatgaaggcagagcgtgtggcatctccacctcaagggtgcagcctgatcttcctcttctcccttgccagccagcactctgccttctgtatccaccatggtgtttggtgagtttttccatcgccctggacaagacgaggaacttgtcaacctgaatgtggggggctttaagcagtctgttgaccaaagcaccctcctgcggtttcctcacaccagactggggaagctgcttacttgccattctgaagaggccattctggagctgtgtgatgattacagtgtggccgataaggagtactactttgatcggaatccctccttgttcagatatgttttgaatttttattacacggggaagctgcatgtcatggaggagctgtgcgtattctcattctgccaggagatcgagtactggggcatcaacgagctcttcattgattcttgctgcagcaatcgctaccaggaacgcaaggaggaaaaccacgagaaggactgggaccagaaaagccatgatgtgagtaccgactcctcgtttgaagagtcgtctctgtttgagaaagagctggagaagtttgacacactgcgatttggtcagctccggaagaaaatctggattagaatggagaatccagcgtactgcctgtccgctaagcttatcgctatctcctccttgagcgtggtgctggcctccatcgtggccatgtgcgttcacagcatgtcggagttccagaatgaggatggagaagtggatgatccggtgctggaaggagtggagatcgcgtgcattgcctggttcaccggggagcttgccgtccggctggctgccgctccttgtcaaaagaaattctggaaaaaccctctgaacatcattgactttgtctctattattcccttctatgccacgttggctgtagacaccaaggaggaagagagtgaggatattgagaacatgggcaaggtggtccagatcctacggcttatgaggattttccgaattctaaagcttgcccggcactcggtaggacttcggtctctaggtgccacactgagacacagctaccatgaagttgggcttctgcttctcttcctctctgtgggcatttccattttctctgtgcttatctactccgtggagaaagatgaccacacatccagcctcaccagcatccccatctgctggtggtgggccaccatcagcatgacaactgtgggctatggagacacccacccggtcaccttggcgggaaagctcatcgccagcacatgcatcatctgtggcatcttggtggtggcccttcccatcaccatcatcttcaacaagttttccaagtactaccagaagcaaaaggacattgatgtggaccagtgcagtgaggatgcaccagagaagtgtcatgagctaccttactttaacattagggatatatatgcacagcggatgcacaccttcattaccagtctctcttctgtaggcattgtggtgagcgatcctgactccacagatgcttcaagcattgaagacaatgaggacatttgtaacaccacctccttggagaattgcacagcaaaatgagcgggggtgtttgtgcctgtttctcttatcctttcccgacattaggttaacacagctttataaacctcagtgggttcgttaaaatcatttaattctcagggtgtacctttcagccatagttggacattcattgctgaattctgaaatgatagaattgtctttatttttctctgtgaggtcaattaaatgccttgttctgaaatttattttttacaagagagagttgtgatatagtttggaatataagataaatggtattgggtggggtttgtggctacagcttatgcatcattctgtgtttgtcatttactcacattgagctaactttaaattactgacaagtagaatcaaaggtgcagctgactgagacgacatgcatgtaagatccacaaaatgagacaatgcatgtaaatccatgctcatgttctaaacatggaaactaggagcctaataaacttcctaattcagtatgga

SEQ ID NO: 252 - DNA, 5020 bp, Homo sapiens
agtgtgcgaggcgcacgcacaggagcctgcactctgcgtcccgcaccccagcagccgcgccatgagccggagtctcttgctctggttcttgctgttcctgctcctgctcccgccgctccccgtcctgctcgcggacccaggggcgcccacgccagtgaatccctgttgttactatccatgccagcaccagggcatctgtgtccgcttcggccttgaccgctaccagtgtgactgcacccgcacgggctattccggccccaactgcaccatccctggcctgtggacctggctccggaattcactgcggcccagcccctctttcacccacttcctgctcactcacgggcgctggttctgggagtttgtcaatgccaccttcatccgagagatgctcatgcgcctggtactcacagtgcgctccaaccttatccccagtccccccacctacaactcagcacatgactacatcagctgggagtctttctccaacgtgagctattacactcgtattctgccctctgtgcctaaagattgccccacacccatgggaaccaaagggaagaagcagttgccagatgcccagctcctggcccgccgcttcctgctcaggaggaagttcatacctgacccccaaggcaccaacctcatgtttgccttctttgcacaacacttcacccaccagttcttcaaaacttctggcaagatgggtcctggcttcaccaaggccttgggccatggggtagacctcggccacatttatggagacaatctggagcgtcagtatcaactgcggctctttaaggatgggaaactcaagtaccaggtgctggatggagaaatgtacccgccctcggtagaagaggcgcctgtgttgatgcactacccccgaggcatcccgccccagagccagatggctgtgggccaggaggtgtttgggctgcttcctgggctcatgctgtatgccacgctctggctacgtgagcacaaccgtgtgtgtgacctgctgaaggctgagcaccccacctggggcgatgagcagcttttccagacgacccgcctcatcctcataggggagaccatcaagattgtcatcgaggagtacgtgcagcagctgagtggctatttcctgcagctgaaatttgacccagagctgctgttcggtgtccagttccaataccgcaaccgcattgccatggagttcaaccatctctaccactggcaccccctcatgcctgactccttcaaggtgggctcccaggagtacagctacgagcagttcttgttcaacacctccatgttggtggactatggggttgaggccctggtggatgccttctctcgccagattgctggccggatcggtgggggcaggaacatggaccaccacatcctgcatgtggctgtggatgtcatcagggagtctcgggagatgcggctgcagcccttcaatgagtaccgcaagaggtttggcatgaaaccctacacctccttccaggagctcgtaggagagaaggagatggcagcagagttggaggaattgtatggagacattgatgcgttggagttctaccctggactgcttcttgaaaagtgccatccaaactctatctttggggagagtatgatagagattggggctcccttttccctcaagggtctcctagggaatcccatctgttctccggagtactggaagccgagcacatttggcggcgaggtgggctttaacattgtcaagacggccacactgaagaagctggtctgcctcaacaccaagacctgtccctacgtttccttccgtgtgccggatgccagtcaggatgatgggcctgctgtggagcgaccatccacagagctctgaggggcaggaaagcagcattctggaggggagagctttgtgcttgtcattccagagtgctgaggccagggctgatggtcttaaatgctcattttctggtttggcatggtgagtgttggggttgacatttagaactttaagtctcacccattatctggaatattgtgattctgtttattcttccagaatgctgaactccttgttagcccttcagattgttaggagtggttctcatttggtctgccagaatactgggttcttagttgacaacctagaatgtcagatttctggttgatttgtaacacagtcattctaggatgtggagctactgatgaaatctgctagaaagttagggggttcttattttgcattccagaatcttgactttctgattggtgattcaaagtgttgtgttcctggctgatgatccagaacagtggctcgtatcccaaatctgtcagcatctggctgtctagaatgtggatttgattcattttcctgttcagtgagatatcatagagacggagatcctaaggtccaacaagaatgcattccctgaatctgtgcctgcactgagagggcaaggaagtggggtgttcttcttgggacccccactaagaccctggtctgaggatgtagagagaacaggtgggctgtattcacgccattggttggaagctaccagagctctatccccatccaggtcttgactcatggcagctgtttctcatgaagctaataaaattcgctttctaaagttacctgttatatatctcttttggtcccatcctctaaagcagaggcaacactggaacatggctagcctttcttgtagccatggctgggcgtgctagaggttgcagcatgagactttctgctgggatccttgggcccatcactgtatagacatgctaccactggtacttcctttctccctgcgggccaggcactgcccttttcaggaagctctcttaaaatacccattgccccagacctggaagatataacattcagttcccaccatctgattaaaacaacttcctcccttacagagcatacaacagagggggcacccggggaggagagcacatactgtgttccaatttcacgcttttaattctcatttgttctcacaccaacagtgtgaagtgcgtggtataatctccatttcaaaaccaaggaagcagcctcagagtggtcgagtgacacacctcacgcaggctgagtccagagcttgtgctcctcttgattcctggtttgactcagttccaggcctgatcttgcctgtctggctcagggtcaaagacagaatggtggagtgtagcctccacctgatattcaggctactcattcagtcccaaatatgtattttcctaagtgtttactatgtgccagttcctgtaacaggtgtggggacacagcagtgagtaatcaatacagacaaggttctgcccttatggagctcacactccagtggcagacaaacagaccataaataaggaaacgatgaaataagatatatacaaggtgagtgtgacttcccttctaaccccctctgctctgtcctcccctattgcgctctcaagaccagagacccaacagcagtgatctcagggcagacagccctccactccagctctgagacccttttctcaggacctctgtaggcagcagagagagaggacagaggggtaagatgaggggttgagggaaggttcttcatgatccacactttgggcttagtatttctcaggaagagctatggcccagaaacaacaggggaaactagagttcggtctgacagtccttggggttaagtctcctgtcttatggtccagaaactcctgtttctccttagttggctggaaactgctcccatcattccttctggcctctgctgaatgcagggaatgcaatccttccctgctcttgcagttgctctgacgtagaaagatccttcgggtgctggaagtctccatgaagagcttgtgtcctgtcctttcttgcagattctatttcccctcttctgctaatacctcttactttgcttgagaatcctctcctttcttattaatttcagtcttggtggttctatcaggggtgcattctggccaaggggtgggcctgtgaatcaatcctgggcaatcagacaccctctccttaaaaactggcccgtggagactgagatcactgactctgactcatccccacagctggctctgacaagatggtccatttgttcctgcttccgagatccccagggcagcctggatccctgcccttctcaagactttagcttttccttccatccggtggcctattccaggaattcctcttttgcttaaatcagttggagtttgtgtctgttgcttgtaatcaagcctttatggctgctgggctgagtgacacaagcactttaatggcctggagggacttttaatcagtgaagatgcaatcagacaagtgttttggaaagagcaccctcgagaagggtggatgacagggcagagcaggaaggacaggaagctggcagaacggaggaggctgcagccgtggtccaaccaggagctgatggcagctggggctaggggaagggctttgagggtggaaggatgggatgggttccagaggtattcctctcttaaatgcaagtgcctagattaggtagactttgcttagtattgacaactgcacatgaaagttttgcaaagggaaacaggctaaatgcaccaagaaagcttcttcagagtgaagaatcttaatgcttgtaatttaaacatttgttcctggagttttgatttggtggatgtgatggttggttttatttgtcagtttggttgggctatagcacacagttatttaatcaaacagtaatctaggtgtggctgtgaaggtattttgtagatgtgattaacatctacaatcagttgactttaagtgaaagagattacttaaataatttgggtgagctgcacctgattagttgaaaggcctcaagaacaaacactgcagtttcctggaaaagaagaaactttgcctcaagactatagccatcgactcctgcctgagtttccagcctgctagtctgccctatggatttgaagtttgccaaccccaacaattgtgtgaattaatttctaaaaataaagctatatacagcca

SEQ ID NO: 253 - DNA, 4360 bp, Homo sapiens
ggagcagcgctgaaggaaggtgggaagccatcagagcaggaagataaaataactgcacaacttactcaaaacccaggacaaattcagagagtcaaggatggaactttgggctccccagaggctgccccagacacgagggaaggccacagcaccctcaaaggatccagaccgagggtttcggagagatggacatcatcggcctgtccctcactcttggcacaatggagagaggtttcaccaatggcaagacaaccgtgggagcccccagccacagcaggagcccagggcagaccatcagcagcagccccattatgcatccaggccaggggactggcatcagcctgtgtctggagttgactattacgaaggtggttatcgcaatcagttgtattcaaggccaggttatgagaattcatatcagagctatcagtctcccacaatgagggaggaatatgcttatggaagttattactatcatggacacccacagtggctgcaggaagaaagagtgccaaggcaacggagtccttatatctggcacgaagattaccgagagcaaaagtaccttgatgaacatcattatgaaaaccagcacagtccatttggaacaaatagtgagacccacttccaatctaacagtaggaacccttgtaaagacagccctgcttccaactctggacaggagtggccgggggagctgtttccagggagcctgcttgctgaggcccagaaaaataagccatcattggctagtgagtccaaccttctccagcagcgtgagtctggtctcagctccagcagctatgagctcagtcagtacatcagagatgccccggagcgggatgatcccccagcttcagcagcttggagtccagttcaggctgatgtctcctcagctggtcccaaagcacccatgaagttctacatccctcatgttcctgtgagtttcgggccaggaggtcagctggtgcatgtaggtcccagctctcccactgacgggcaagcagcccttgttgaactgcacagcatggaggttattcttaatgattccgaagagcaagaggagatgagaagtttctcaggacccttgattagggaagatgtacataaggtggatattatgacgttttgccagcagaaagcagctcagagctgcaaatctgagacactggggagcagagactcagctctactgtggcagctcttggttctcctttgtcgccagaatgggtccatggtggggtctgacatcgctgagctgctaatgcaagactgcaagaagctggagaagtacaagcggcagccccctgtggccaacctcatcaacctgaccgatgaggactggccagtgctgagctctgggaccccgaacctgctcacgggagagatcccccccagtgtggagacacctgcgcagatcgtggagaaattcactaggctgctctactatggaaggaagaaggaagccttggagtgggccatgaagaaccacttgtggggccatgctttgttcctgtccagcaagatggacccacagacctacagctgggtcatgagtggcttcaccagcacgctggcgctcaatgacccactgcagaccctcttccagctcatgtcggggaggattccacaggcagccacgtgttgtggagaaaagcagtggggagactggaggcctcacttggctgtgattctgtcgaatcaggctggggacccagagctgtatcagcgtgcgattgttgccattggggacaccctggctgggaaggggcttgtggaggcagctcacttctgctatctcatggctcacgtgccctttggccactacaccgtgaagacagaccatctggtcttgctgggcagcagccacagtcaagagtttttgaaatttgcaacaactgaggcaatccagaggacggaaatcttcgagtactgtcagatgctgggccgccccaaatccttcatcccttctttccaggtgtataagctcctttatgcttcccgtctggcagattatggcctcgtgtcccaggctttgcattactgcgaagccattggtgcagctgtcttgagccagggagagagcagtcaccctgtgctattagtggaactcatcaagctagcagagaaactgaagctgtcagatcctctggttttagaaagacgcagtggagacagggacctggagccagattggctagcgcaacttcggaggcagctggagcaaaaggtagcaggagacattggggatcctcatcctactcgctcagatatttcgggagccggaggaacaacaacagaaaacactttctaccaggacttttctggatgtcaaggctactctgaagcccctgggtaccgctcagctctgtggctgacacctgagcagacctgcctgctccagcccagcccacagcagccctttcccctccagccgggctcctacccagcaggagggggtgcagggcagacagggacaccgaggcctttttactcagttcctgagacccatctaccagggactggcagcagcgtggcagtgacagaggccactggaggaacagtctgggaggaaatgctgcagacacacctgggccctggagagaacacagtgtctcaagaaacttcccagcctcctgatggccaagaggtcatttccaaaccacagacaccattggctgctagaccacgaagtatttctgagagttccgccagttcagccaaggaggatgagaaggagtcctctgatgaggctgataaaaactctccccgaaatactgcccagagaggcaagctcggagatgggaaggagcatacaaagagctcagggtttggctggttcagctggtttcgatcgaagcccaccaagaacgcatcccccgctggagacgaggactcctcagacagccctgactctgaggagacccccagagcatcttctccccaccaggctggcctgggcctctcactgacaccttcccctgagtccccacctctgccggatgttagtgccttctccaggggcagaggtgggggtgaaggccgaggatccgcatccagcgggggagcagctgcgggcgctggggttggaggcttgtctggaccagagagtgtttcctttgagctctgctccaaccctggtgttcttcttcctccacctgccttaaaaggggctgttcctctttacaacccatctcaggtgcctcagctgcccacggccactagcctgaatcggccaaatcgcctagctcagcgtcgctatcccacccagccatgctgagaataaacacacgtcccaggctcatctcccaggactgaaactttcttgctctctttttctcaatctcccagcccctctctaccatattgggaccctcaagaggtttgtgctagcccgatgcctccaccgggcacttagaaggcaagaggacaggatctctcaagacacagcacaattcagtctcttaagattagcttcacaatgatggaaattatttcatcaggtggaaagtctgggtctaatagcagactgcacatgagcagagtgacatggtggtggcacttatggtggtggcttgagagccttggggaaattagggccctaacagctagaatcaaagatgataccgcagggccctgtagcaagaaatgggaagcagggggaggggcaggggctcagaacaatattctagaccaactttgactacttcctgtcttagtaatagaccaatacatggctctatttagcaaagtttttatactgaaacttgattattgctgccctttataatttcctcttcaatgatatttcagcagtttccctcttggtcctagttttgtgcacatttttttgaatgtggttcagattaattatatttctctcactttcttagctggtcctattttttcacattctggcatgtggctatcaagttagattgctgtaggcatcatattgtcatggtaactactgaacctaatgatgcagatggatggcacatcagtataataaatgatggaaaacggttcctaaaaattcatccctttcataagaggggaagaatgagtgcctgatattgttaatacctccctttctacctcaggcctttgcaaattgatgttcagagggtcactggagtgagagggaggaggggggcgtcttggaaatttccatttctcttttcaaacccaaaataggaatgactcttgctgtttgtcagatttgctgaaaattgctcctcacaaagaacatttttttttgtacatgtaattgtaaatacaggtttagtacgttaatgttctatagttctgatattgataataattaaacccagataattttatagcaaaaaaaaaaaaa

SEQ ID NO: 254 - DNA, 9096 bp, Homo sapiens
actttgcactctcctctagcggccgcctgtcctttttaaggaactccaccctaggtggagtcctcacgatagtcacacctctcctttgggcctagcagggccagagaaagacggaatcactctacccactcaggttgcccagagagcactttaggttctgactcgcgtggggcgcgaggtaccccgtggggcagctaggtgcctccaagaaaccccgccccagaggacccgcacgagttgctgccatttttcgctgaagcccctgccctggggctggtgttcttctctatgattctaccaatcgtcggcatttttttcctcccttctttctttttaggaaggcgctggggtgtgcggcggcaacggcggcggtgaagggatcctcttgtggtatctcctcgtgggttcctgtcttgaaggatttcttctccgcctcaactttatgttcaagtagcgctttgggggttgggttggttttcatagcccccacccccggccctctccttttaaagggtgtgtggagttcagaggatgggtggagagcgggcttggccggaactgaattggtagaggtaaaaggggaacggaggaccttaagctctggccacttcggcccagcgaacccactttatttttgtccaaggaaaagctgcaggggggaggattctttttaggaagtctactctgccggcccctgatttttgggttggatgcttgagagctttgtttcccttgttccgagagtggcccagctgggtctgaatcgactccctcccctttcgaccccctcctcattttccagcccggagaaataggggagtgggggcccaagaacgagaagacgagaacgcgtcgccctgcgctatgtcagaatggggcgggtgtgaggggaacagctctcttgcgatcagctcaggagtatgagcctcccggaggacggcatgagttctggacacttcaggagtcctcagctagtgacatggtcgatatggataaactcataaacaacttggaggtccaacttaattcagaaggtggctcaatgcaggtattcaagcaggtcactgcttctgttcggaacagagatccccctgagatagaatacagaagtaatatgacttctccaacactcctggatgccaaccccatggagaacccagcactgtttaatgacatcaagattgagcccccagaagaacttttggctagtgatttcagcctgccccaagtggaaccagttgacctctcctttcacaagcccaaggctcctctccagcctgctagcatgctacaagctccaatacgtccccccaagccacagtcttctccccagacccttgtggtgtccacgtcaacatctgacatgagcacttcagcaaacattcctactgttctgaccccaggctctgtcctgacctcctctcagagcactggtagccagcagatcttacatgtcattcacactatcccctcagtcagtctgccaaataagatgggtggcctgaagaccatcccagtggtagtgcagtctctgcccatggtgtatactactttgcctgcagatgggggccctgcagccattacagtcccactcattggaggagatggtaaaaatgctggatcagtgaaagttgaccccacctccatgtctccactggaaattccaagtgacagtgaggagagtacaattgagagtggatcctcagccttgcagagtctgcagggactacagcaagaaccagcagcaatggcccaaatgcagggagaagagtcgcttgacttgaagagaagacggattcaccaatgtgactttgcaggatgcagcaaagtgtacaccaaaagctctcacctgaaagctcaccgcagaatccatacaggagagaagccttataaatgcacctgggatggctgctcctggaaatttgctcgctcagatgagctcactcgccatttccgcaagcacacaggcatcaagccttttcggtgcacagactgcaaccgcagcttttctcgttctgaccacctgtccctgcatcgccgtcgccatgacaccatgtgagccgcacaggtcacactagagaagctgcgctggtatctttcctggtcgtgtgctgaggttgggacaattttttcctctttgacttcagcttgcatatggggttgaagcagcccactgagccaagttgaggagactggaggaaaagagagctggtctcccgtggggctcttcatattctaccttcacttctccactgtccagacccgtttttttcaacctccacatgggttgaattccagtgtggcacccatggctgccttcccatccccccctgctctgaaataggacatttttcctacagtaacaaaacaggaatcaaactcaaggctgtgaacaaacatacgctgctttattctttccaatttttctcttgttttctagaactcttatccatatgtttttaaaataagtacctaaaagtggtttgatagtgtcctaaacgacttttttaacttcctaaatggaaagagcataacaatgtagttgattggtaagatttacagggatttggtttctgagtttgaggcacattcccagtgaataagctgagtcccataccacactcaaaaggttttaataaatctaatcctatttcttcttaaagtttggttttcagacagtgctggtgcttctgcttcttaagttcatcaagggaatgaggagttcttgtccttctcctcctcttttttttcttttccactttctccttcaggattaaagattttgctgcacaattgttatttgttaggttaaatttggacaaatattcaaagcacacatagacatataagtaaggagaaaaatgttccaggagagtaggttgggcagtgacaggaacaaacagacctaggatgatcctgagaacaaatagaggggttcctttacttgtataggatatcaaaagtgctgttaatcacaaacctcattcaaatggcaggctgtcgagacagtgtcttgaggggctggctgtactgtttattttttcgtttacacaaagaagcaattgagtatattgcatgatgagaaatcacacactagggtcatgttatacagaagtaaggggttggaaaaatggaatgttgttcactccatggaattattggcattcattcctgtgtttcaaatgaaacatagatgcttttcatgaaaactgacctacaaaaagcaatttgatgttctgcaactgctatgaaaacctaagccatttattttagctgatagcagattgcataatatactcatttagctgcccaatcagattgttttataatattacctggggtacaaaatcctctgttcctggccctggaccacagatctacctccacatggcatatttcctttctggggtcaggggtaggggagggggctttgcatcacttgaatttagactcagcctctctttaaaagattgtctttatattgaacacctttttcttttcaaccctgcttgaatactttaggttactatttcctgaggctgtccattctcactatattgtagaattctagcaccaagaagggatcccgttaaccatctagtcctatccatccctcatattttacagatgagacaaatacgggtcagatttttttctccagatgtttctttgagcccttatacacctgcacgcttattctcctggggatcacataattttatttatttattttttgagagacggtttcactccatcacccaggctggagtgcagtggcgtaatcttggctcactgcaacctccgcctcctgggttcaagtgattctcctgcctcagcctcccaaatagcttggattacaggtgcgtgccaccacacctagctaagttttgtattattagtagagatggggtttcgccatgttggccaggctggtctcaaactcctgacctcaagtgatccccccacctcggcctcccaaagtgctgggatcacaggtgtgagtcaccacacctggccaggatcacattattaaaccaaattaaagtttatgtgattggttgcaatatttgtctaattttatatgttttcttcaggaaaactttagaactcaaaaatcatttacagctgattaaatagcaagtaaaatgtacttgtggtcattgccgtataacattaggcacacgcttctaacacttctataatatctagattttatttacctcattttaacttgcaatgtctgtctatctcatgaactctccataaatccaagaactgcctgtagttttcaaaatgacatgtgggtttttactgttatcattgttatttcgatagggctttttcctgattttgggtatacaagttccaaacttgcataataattgctaacgcactaggcgatatctagggccagtctgttaaaggggacctctaatgtagctataagacaggttggtaaagatgaactaacataagtttaagctaataattcagtagttgatgcagtatttcacagtagagcccgagcttactcatttttttcaaaatttggatcctgatactcctttttcagagttcagaactgaactgctcccctaagacctcagaatcttttgcattgagacatatgatctatttataaataaaggttatcaaatatcttgttgaactaattaggttgatcaaattaggatcccaaatattggggtccctgacatctgagcctttatctaaaaatgtttctgtaacataatgacagcctttatgtttgttaattgcctatagtaaagaagcaattttaagcctattctcatttccctctcccctacaaaaaatgataaaagctttccaattacttacatatgctctaacaagtgtctcaggattcattaacagaattttatagagtacagtaattcaaatatagcacagtacagagtttaccaaaaacacataaaactttgctagatagacagtgaggtggaaaggaactaaaatgtatctctcttgaatagcatttggggttcaattgaatttgttgtgtttacaacagcaaagcaccgttagcctggacagttgcttatggcatcgatagggttggataatattctgggatttgttgcagcagaattcctctatctgatgatcagcagttgaacataaacttcataattatagtaaaatttaggaaaaactatgagtgtgaagagtatgaactgattgggtagattaggcagagtgcattatgggcaagacaaaggttttcgatattaacttcttttaaaataaactttttattttcaaacagtttcagttttacagaaaaaatgtgaagctagtacagagaggtctcatttaccccacacccagtttctcctgttattagcatctcacattaatatgtggtatatttgttacaattaataaaacacattgatatgttaatattattaactgaagtccatactttattcaggtttctttagtttttacctaagatcctttttaaagaattgtttcggccaggcactgtggctcacacctgtaatcccagcactttgggaggccaagacgggcggatcacgaagtcaggagttcgagaccaacctggacaacatggtgaaaccacgtctctattaaaaatacaaaaaattagccaggcgtagtggtgggtgcctgtaatcccagcaatacttgagaggctgaggcaagagaattgcttgaacctgggaggcggaggttgcagtgagctgagatcatgccacttcactccagcctgggtgacagagcgacacacttgatctcaaaaaaaaaaaaattgtttcagcatcttgttcaggattccacattacatctaatagtcatatctccttaggatccttttgattgtgacagtttctcagactttccttgttttcagtgaccttgacacttttgagagagattttcctcaactgggatttgtcagttgtctttctcatgattagactgaggttatgagtttttgaaagtaggaccacggagaagaagtgccattttcatcacatcatacaggcatactttggagacaatgcagatttggttccagatcactgcaatgaagcaaatattacaataaagcaagtcacacaaattttttggtttcccagtgcatataaaattttatgtttacactatcctgtagtctggtaaatgtgcaatagcattatgtctaaaaaacaatgtacataccttattttaaaatactttattgctaacatgttactggcacaaacacgaagtgagcacatgctgttggaaaaatggtgccaatagacttgttggtcacagggttgccacaaacttttaatttgtaaaaaatgcaatatcagcaaagtgcaataaagtgaagcacaataaaacgaggtatgcctgtatttacatgactcatcactgttgtttaaccttgatcacctggctgaaatagttgttgtcaggtttctcccctgtactctttttttcctcccctccatactgtactctctgaaaggaaatcactatgtgcagcccatgcttctggagtggtaagttatatgccacacccttcagagcatgtatcttacataaattatttggaattattctctaagggagattgtctcttctcccccatttatttatttatacaatactttatttatatcagcatggactcatgggtatttattttatacttcgagttataatctaatactactactttattttattgctcgaattgttccagctttggccattgggagctcttttgggtgattctcaagttcttttgacacacccccatcatttttttttagcacgtccttactttctgccactgcaagatcttccaggctcatcttgtatattttgtggcctactcctataatcagccatttcttcaagaagtcctggtttcttttactggaaaattgtattagaaaccaatatctgggcattaggtatgttcattgttactgggctattgttgcttctagggtgtctcagctaacagcaaggaaacatatgtgtgtatactatcctatgtatatgcacattctataaatatttctatatgtaatcacccagatttttatttagctaaacatgagttcatattgatgttttcaactctaacctgttaccacgtgaatcattctagcttcttcctgttagttacatgaagcctcccacactaatactgagaaacctggctctcaacctctgtcatctatttacttaatttttcaaattcagtgtgcacatatagcagtatctgaattgttaacctgtatacccatgggaaacaactttatcaactacagcacagtgtgtatgtacataaaaatagtaatatttttagaactccaacagctctttgaaacaaagtggtctgcaaaattctggaattagggatttctgtgatctgagttccaagattctggggtctatcctgcccccaaaaagttttctcatgaaccaaaccatcaagaatgtacctaaccttaaataagccaagggaacttactgatgctccacagtttgctaattcttgtatgaggtactgtagagggatggatacagaaggaactgggtgggccaaatttaaataaacacatagcactatcttttctcactgttaaatatggctctctgacaacagtgatgctaccctgagttacctctcttctgtattttcccagatctcacttggttgaccttaggcaagtcatatcacctctctgtgcctcaattaatccatttgcaaaatggggatctcaatatctacctcacaggaatgttgtgaggcttctcataaattgattttggcaaaaatgaaagatctttaagtgaacaaccaagtattataaccattgttataatgatagttatagtaccttatatttaccctatgtaaaagagaagattaggcttcctaggtgataaacagataaatttgagtaagaaggataattaaagagtggccactggaagcaatattatttattctcttactttcactttccctatatcttctttgttactaacaatacgattatcatctgtttccatacttgaaatgtattaggacctaaaggaagaggtaggcaaaattcattgcttcagaagctgtattcttccccctttgtaactctgcttggaccacattccatgtcacattctcagaagcacaaaggcaattttccagagccctttaagctttggccagttcagtttcaccacttatattttctctttcccaacttactttactctgaatagtataggtaggaggagggaagttgggtagggtggttgggggtgggagtgggttggaagaggatgggatttataccagtggcaggatatttctctgttttccaaacactggttttaatttccatttccttttctggtgttggggtggggtcaggggaagagatactattttgttaactgttaaaagctctccttcctttcctagagtcgctacaagtagctgtgttggacattactttataactatgctgtatgccatgctgttttcattgtatcacagaattaaaaggggaagagagttcctagtggtgtccatccctgttttttgacaggcagtcacacaggtgagcagtgccagaaactggttctcttttttgtgttggggaaaggagcctgcagtgaaaggatcagttggattttttgtcattgttagtttgtttaaataaattataagacagtatattaagctttagtctctgtaactcttatgtttgtgccccattattttagtgctttagagcaacaccttgtttttcctctattttatactagttcttgctccagaggcatggctttgaggctagaatcatgagcaatctctcataaacaagtctgttatgcacctggagatactcaagatttgcctctgttagcatggccacttagagattactctgttctacttcagagaccctccactatggcatccatgcagggtgtgtgcttggggactaagcaatcttgttcagtttaattattgtacttttttattaataaaaaggtcttaaacttcagaaa

SEQ ID NO: 255 - DNA, 7232 bp, Homo sapiens
cggcgaacagacgttctttctcctccatgcagttacacaaaaggagggctacggaaactaaaagtttcggggcctctggctcggtgcgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacccgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtagttaacatgtgaacttttatgtatgatacataattggctttaacatgttggtccattcccaccttggtttaagtaacgtcataccaaagtccatggatatatgaaaggatacaattaagttgcctgtttgttctttatgctgaaaggaatatatgtcttccaattgcccactacatatgcacaaaatctgctggataagttttaagagggatatattctgaaagcatttttgtttgttgcattgtaccaggactaaaaaaagaaggattggaagttctgccatcaaatttgggtatcataaaaagtttttaactgatttttcagcagtattgggaagtttcttaaacatactttaaggattataaatatccctatagacagctgtgaataccaatatacattaccctggaaaagttttactccaagttcaaaaatcatataattgaatatcaagaaatagatgttttctgtttgtatcataagcatttatagaaaattattctaaagcttaatggtttgctataattctcaaatactaccactagcttataaatcacttttatgtggacacacacatgcctattgaatttaaaaaggaatgagatttaaaaattaagtgcatatatataatatacatatatatatatatatatatatatatatattttttttttttttttttttttttttttttttgggacagagtgtccctctgtcacccaggctggagtgcagtagtgtgatctcggctcactgcaacctccgcctcccaggttctcaaacagatttaacaatcctctgagaatggtactcatttatttggctaaaattcttcagggatttataaactacttgctaaaggagggcattagataatcaagtatttttaattttccatcttgttatactttttattttaaatgcctaaaaccatacagtattgtgtgatgtgtaattcctagtatacaagctacctagagtcaggctggttcagtaataaatttttttaaaggcaacactgattattcagttagtcctatttctttctcttgaggcagttctcaaaactctaaagacatgaacactgcatcgtacctaaatggctactgttctctaacgtctttatcctatggattcaatttggaagccatcattgatctttggcatcaaaagaaaagtcatttttaaagcatttcttttcaaaaatatataaatattgccttaaattccatctaggattcccttagtacaaggtagtttcttaggtttgtaattactaaactactgactgttttaatgcagatgcgttattgtatttattaacccagtttctttgggtctgcctagacttcacctgaatgtacagttttcacattcttgattgtttctctttgtgatagtcacaactgtgaacttataaagtcacatttttaaagttcttcctagagacattcactctgtctttattaaaaataataataataataataaacgttatcttgttggccaaaaaaaaaaaaaaaaaa

SEQ ID NO: 256 - DNA, 3265 bp, Homo sapiens
ggctgcccgcacctgcacccgcgcgtcggcggcgccgaagccccgctccccgcctgcgcgtctgtctcgtccgcatctccgcggcctcctgctccacgacgtgaccatggccgggctgcaggagctgcgattccctgaggagaagccgctgctccggggccaggacgccaccgagctggagagctccgatgccttcctcttggctgcagacacagactggaaggaacatgacatcgagacaccctacggccttctgcatgtagtgatccggggctcccccaaggggaaccgcccagccatcctcacctaccatgatgtgggcctcaaccacaaactatgcttcaacaccttcttcaacttcgaggacatgcaggagatcaccaagcactttgtggtgtgtcacgtggatgcccctggacaacaggtgggggcgtcgcagtttcctcaggggtaccagttcccctccatggagcagctggctgccatgctccccagcgtggtgcagcatttcgggttcaagtatgtgattggcatcggagtgggcgccggagcctatgtgctggccaagtttgcactcatcttccccgacctggtggaggggctggtgctggtgaacatcgaccccaatggcaaaggctggatagactgggctgccaccaagctctccggcctaactagcactttacccgacacggtgctctcccacctcttcagccaggaggagctggtgaacaacacagagttggtgcagagctaccggcagcagattgggaacgtggtgaaccaggccaacctgcagctcttctggaacatgtacaacagccgcagagacctggacattaaccggcctggaacggtgcccaatgccaagacgctccgctgccccgtgatgctggtggttggggataatgcacccgctgaggacggggtggtggagtgcaactccaaactggacccgaccactacgaccttcctgaagatggcagactctggagggctgccccaggtcacacagccagggaagctgactgaagccttcaaatacttcctgcaaggcatgggctacatgccctcagccagcatgacccgcctggcacgctcccgcactgcatccctcaccagtgccagctcggtggatggcagccgcccacaggcctgcacccactcagagagcagcgaggggctgggccaggtcaaccacaccatggaggtgtcctgttgaagcccttgatcccgctgacgacgcccacgtcgaggccccaccgccatccttgcgccggctcatgttccctttagtttatttttgtgagggcaaaggggaggaaatggggttctgtttgaaaaaaatgaggggatcttagatgctgcagcagaacagtctccaggtgttttaaggggctcagtcctcctcatcccatctcactctccgtggtaacttagccaacttgacccctctcatcccactcccggcggcccaggcacagaagggcagggccatagggagggagattcgctacggatccaggccattcctgggtgagcccttgggcaggcatgtttggagatgagagaggcttcgagagggtgggtgctgggccacaggggtgcggggccagctcaggcactggcgtgggagccctgggagaccccttcccccaccctccaccaagcacacctgtttctgtctcatagcacatgtgacaatcatctggacaacagccacaagggggcgctcggaccaggcagccactttcctggtgctctctgggcccagctggtgctgtagggccacgcaggcaggggcgtcaaggggtttctctgcccaaggaagacagaacatggagaaccgtcagggcaggaaccccacagactgtcccttccagcccacactctgccacctcctggccctgtcccaattctgagccaaggcctccccgaggcagaagttgcctggtcctctgtccccacagtgacctgactgggggtgagggagaaggaggagagagcccatgtgtggtgtgtgtgcccctgagaacttcgtggtgactgcctttgggagcccgcaggtggccagaggcaggggtagctgagttcctggagaccccttttttgcccccaggttccccagagggcaacgccatcagtagcagtgtggtgtttcaggcagagctctggccaggctgtgccagtgtgtcccggacgcatcactaaggaagagagagtttatttagtcaactggcccaaggcagcgaggcttctacagtcccacaccccatagccgcctgggctggggcttactgggggctgaaggttctggacatgaacaagggtcaggtagaagagaaaggcttcccctacaccccagcctcctgctgtcccctgaagcccaggactgcgttgtatgctttccatccactcaccttaccccatagcatcttgcggcccagaaaccagagccatttgtctcagaccctaaatcaataatcacaaaccccaaaacgggagagagcagtgaaaacatgcagggctgtggacgggggaagggttgtggcgggtgttctgaggctgagaggacacctatatgcgtatttcctctacacacatcaccccccttctataatcttaagccatgactagcctggtggcgtgttagtttctgcccagttctaccccctcatgtgcttcttctgaatactgaatgtgactgtttgaaagctggtagaattcatccctcttactgtagataacactgcaaatcttggaattttgttttttgctgtttccagatgtatctataaatatctatacattatatgtgtgtgtgtgtgtgtgtgtgtgtgtgtacatcgggtcctcccatgtgtggtgttcttctggaggttgtctctttggtcaaggtgaacttttaatgtttattattttcttctccgcacaaagtaaagagcctaattttgtgtattctggtggctgctgtcatgagatgataaaatgtaaaacaaaactctagtcaacgtagaaagagttaactgtgctgaaaaactaataaagaacctaagaagaattccagtgtggtgatgccatgcccatcatgggaggcttttggagaaacagaatgtttgggcaggggctgctggtgctgcttgggttttgggttgagggtgctaggagaggatggtctccacccatctttctatttccagtacacgtcacattattttaccggtgagatgagaatgtcacaaacattaaaagccttatgtgctca

SEQ ID NO: 257 - DNA, 3062 bp, Homo sapiens
agagctgagatcctacaggagtccagggctggagagaaaacctctgcgaggaaagggaaggagcaagccgtgaatttaagggacgctgtgaagcaatcatggatgcaatgaagagagggctctgctgtgtgctgctgctgtgtggagcagtcttcgtttcgcccagccaggaaatccatgcccgattcagaagaggagccagatcttaccaagtgatctgcagagatgaaaaaacgcagatgatataccagcaacatcagtcatggctgcgccctgtgctcagaagcaaccgggtggaatattgctggtgcaacagtggcagggcacagtgccactcagtgcctgtcaaaagttgcagcgagccaaggtgtttcaacgggggcacctgccagcaggccctgtacttctcagatttcgtgtgccagtgccccgaaggatttgctgggaagtgctgtgaaatagataccagggccacgtgctacgaggaccagggcatcagctacaggggcacgtggagcacagcggagagtggcgccgagtgcaccaactggaacagcagcgcgttggcccagaagccctacagcgggcggaggccagacgccatcaggctgggcctggggaaccacaactactgcagaaacccagatcgagactcaaagccctggtgctacgtctttaaggcggggaagtacagctcagagttctgcagcacccctgcctgctctgagggaaacagtgactgctactttgggaatgggtcagcctaccgtggcacgcacagcctcaccgagtcgggtgcctcctgcctcccgtggaattccatgatcctgataggcaaggtttacacagcacagaaccccagtgcccaggcactgggcctgggcaaacataattactgccggaatcctgatggggatgccaagccctggtgccacgtgctgaagaaccgcaggctgacgtgggagtactgtgatgtgccctcctgctccacctgcggcctgagacagtacagccagcctcagtttcgcatcaaaggagggctcttcgccgacatcgcctcccacccctggcaggctgccatctttgccaagcacaggaggtcgcccggagagcggttcctgtgcgggggcatactcatcagctcctgctggattctctctgccgcccactgcttccaggagaggtttccgccccaccacctgacggtgatcttgggcagaacataccgggtggtccctggcgaggaggagcagaaatttgaagtcgaaaaatacattgtccataaggaattcgatgatgacacttacgacaatgacattgcgctgctgcagctgaaatcggattcgtcccgctgtgcccaggagagcagcgtggtccgcactgtgtgccttcccccggcggacctgcagctgccggactggacggagtgtgagctctccggctacggcaagcatgaggccttgtctcctttctattcggagcggctgaaggaggctcatgtcagactgtacccatccagccgctgcacatcacaacatttacttaacagaacagtcaccgacaacatgctgtgtgctggagacactcggagcggcgggccccaggcaaacttgcacgacgcctgccagggcgattcgggaggccccctggtgtgtctgaacgatggccgcatgactttggtgggcatcatcagctggggcctgggctgtggacagaaggatgtcccgggtgtgtacaccaaggttaccaactacctagactggattcgtgacaacatgcgaccgtgaccaggaacacccgactcctcaaaagcaaatgagatcccgcctcttcttcttcagaagacactgcaaaggcgcagtgcttctctacagacttctccagacccaccacaccgcagaagcgggacgagaccctacaggagagggaagagtgcattttcccagatacttcccattttggaagttttcaggacttggtctgatttcaggatactctgtcagatgggaagacatgaatgcacactagcctctccaggaatgcctcctccctgggcagaaagtggccatgccaccctgttttcagctaaagcccaacctcctgacctgtcaccgtgagcagctttggaaacaggaccacaaaaatgaaagcatgtctcaatagtaaaagataacaagatctttcaggaaagacggattgcattagaaatagacagtatatttatagtcacaagagcccagcagggcctcaaagttggggcaggctggctggcccgtcatgttcctcaaaagcacccttgacgtcaagtctccttcccctttccccactccctggctctcagaaggtattccttttgtgtacagtgtgtaaagtgtaaatcctttttctttataaactttagagtagcatgagagaattgtatcatttgaacaactaggcttcagcatatttatagcaatccatgttagtttttactttctgttgccacaaccctgttttatactgtacttaataaattcagatatatttttcacagtttttccaaaatcagagtggaatggttttgttatagatgctgtatcccactctttattcatgttcacattttaaaatcatttggaattctgcttcactcgcttaacatatacacaacacctgtaacatacaaggcaatgggctaggtgctccagaccgggaaaaggagggacaggaatgcttggtctgatgggctaatatggcatttagagaagtaccaaggtacagtggagccggtcacaaaagggcagacttgtagtagaattcagttgcaagagggattggggaatcttaaggaaaaaatagaatcttaaggaaaaaataactgggtgagacgtggactgtggacaggtgtggaaaaggcactctccatggaggtatgaatatgtagagggccaagagaggggagtacagggagaaatgagttgagcttgtctgaagtgaacttcaggaagaggaacataggctggaatttagattatgggggctctgaacaccaaactgagtttggacttaattgacttctg

SEQ ID NO: 258 - DNA, 5370 bp, Homo sapiens
agcaggaggcgacagctgccagccgaggaggcgcggcggagaggggactgcggtcagctgcgtccacttggggctgtgcggcggtcccgcgcccggcgatgttcccgggcactccctgagtagcggcagcttatcccccgcccgctagcccgccctggtccccggctcgctcgctggctggcgcggccccggccccgctctgcgtcggccccgccgcggtggaggcgcgcgagggggacgcggccggggatgagcggattgcgggtgaactcgccgcccgggggccccgcgaagccgtgagccgctgcttttctccgagtcgccgccctgcccttggatttgagatcatgtccatccacatcgtggcgctggggaacgagggggacacattccaccaggacaaccggccgtcggggcttatccgcacttacctggggagaagccctctggtctccggggacgagagcagcttgttgctgaacgcggccagcacggtcgcgcgtccggtgttcaccgagtatcaggccagtgcgtttgggaatgtcaagctggtggtccacgactgtcccgtctgggacatatttgacagtgattggtacacttctcgaaatctaattgggggcgctgacatcattgtgatcaaatacaacgttaatgacaagttttcattccatgaagtaaaggataattatattccagtgataaaaagagcattaaattcagttccagtaattattgctgctgttggtaccagacaaaatgaagagttaccttgtacatgcccactatgtacctcagacagagggagctgtgttagtacaactgaagggatccaacttgcaaaagaactaggagcgacctatcttgaactccacagccttgatgacttctacataggaaagtattttggaggagtgttggagtattttatgattcaagccttaaatcagaagacaagtgaaaaaatgaagaaaagaaaaatgagcaactcctttcatggaattagaccacctcaacttgaacaaccagaaaaaatgcctgtcttaaaggctgaagcgtcacattataactctgacttaaataacttgctgttctgctgccagtgtgtggacgtggtattttacaaccccaatttaaagaaagttgtagaggcccacaagatcgttctctgcgctgtaagccatgttttcatgctgcttttcaatgtgaagagtcccactgacattcaggattccagtatcatccgaactacccaggatctttttgctataaacagagatactgcatttccaggtgctagccatgaatcttcaggcaacccaccattacgagtcattgttaaagacgccctcttctgttcttgtttatcagacatccttcgcttcatttattcaggtgcttttcagtgggaagaattggaagaagatatcaggaagaagttgaaagattctggggatgtttcaaatgtaatcgagaaagttaaatgcattttaaaaacaccaggaaagattaattgcctaaggaattgcaaaacctatcaagccagaaaacctttgtggttttataacacttccctcaagtttttccttaataagccgatgcttgccgatgttgtcttcgaaattcaaggtacgacagtgccagcccacagggccatcctggtggcccgttgtgaagtgatggcagccatgtttaatggtaattacatggaagcaaagagtgtcctgattcccgtttatggtgtttccaaagagactttcttgtcatttttagaatacctgtacacagactcctgctgcccagctggcatattccaggccatgtgtctcctgatctgtgccgagatgtaccaagtgtccagactgcagcacatctgtgagctgttcatcattacccagctgcagagcatgccaagcagggaactggcatccatgaaccttgatatagttgacctgcttaaaaaggccaagtttcaccactctgattgcctttcaacctggctacttcatttcattgctactaactacctcatcttcagtcaaaagcctgaatttcaggatctttcagtggaagaacgcagttttgttgaaaagcacagatggccgtcgaatatgtacttgaagcagcttgcggaatacaggaagtatattcactcccggaaatgtcgttgcttagtaatgtaacctggagcttttatacactacatttcttttttattattatgaagaatgggatacctccaggttccagtaaaattcttctgaccgaaaccaatgtgggtgttagaaaaattaccatatagcttaatatgtttattagttctctttggaaaaaaactaccactgtggtcttaaaagggaacaaaatataccataggctaaaactaaggctttcactctagaatgcaaagctgttttgcagctgttttcccttaaagatgtcctgttgctttagtgatatttagacccctctcagttaagaaatgcttagattaaaaaaaaaaaattacgtaggattaatacagaaatttaatcatgtctgattaattgctctattaaaataaggggcatttaaagacccagcataaccatttgtataatgagaaatctaggggaaaaccaatcagtccaacatgagattttaggaatagaaatttgccggccatttggaaagtgaaatgccacttagttctcaattgatgacagtgtttgaatcatcataaaaaaaatacctgcttttcatctggacaacccaattgagccactttatctccttttggcaatctgagtaggcggggaacctaggcagggctggctttcttagcgtgtaacttgtgtagcagcacagggcccacacttagaaggaccccacacttggttcaaggctctgctatagcggaaattcttaataatgtttgaagaagggccccatgatttcattttgtgctgagccctcaaaattatgtctgtttcgtggtgggaaatatcctatgttttcttgctcaaacacctttctctctgaaagcagaaaaaggcactgatataaagggaagagaaggaggctcaccggagggaagagaacatagtgaagattcccgcctttggggaggtctggaccacccagggcctccactgccaccttggctggcaagggagaaatgtgttgtgttgtcttagctttaaaacagtcacagttcttgctctatcatagatgaacaaatactttcttgatcattctgtaagaccaggaggttggtaagagtgactaaccagcctaactttaatacacatgtataaagatgttcacagagaaagatgctctgtagagaatttgctaccgaagttggctcaagaatttgtttttagtgttatttaccaagattaggacgtcagtggcttaaattctttgaattcttttcaaggactgcaagattatttgataaagagtagcatgaatcttgtgctctaatattacacagtaagttcaaagaaaggatgtaagtcaaagacttgttacatagagggaaaatggactgggatagaggacagactgatagtttctttctttcatatcacatgtatagagaaataattatatcagaaactcacaaacctagacatggaaaaacagattactgtctattgtcagcatcattttcatctgtaagtcactactggaatatatttttcttttaatttccagtgactttagaatacacacagtttttccgacttttcaaaaatttgattaaatggttttatagtataatattgggaccccataccgttagcccttgtatgtataccaacactgccaaagtaaaacattaggtcaggcatggtggctcaggcctgtaatcccagcattttgggaggctgaggcaagtggataacttgaggtcatgagttcgaaaccagcctggccaaaacagtgaaaccccgtctctactaaaaatacaaaattagccagatgtggtggcgcacacctgtaatcccagctactcaggaagctgaggcaggaaaatcgcttgaacctgggaggtggaagttgcagtgagccgagatcgcaccactgcactccagcctgggtgacaagagcgaaactccatctcaaaaaaaaaaaaaaaaccaaagtgaaacactaaaaattccctatagatatattccaggaaatattttaattgggctgattttaattaggctgtatcattgatgattactggaatcgattttatgtcttttgtattttaatcacttgagttaatcaaccactggcaaatcccatttgacaaagattagcattgtaaaaaacagatactgtggtagatttctagaaattcattcacatttaagacttctaaaatggaataatagccttttgtttttcatgagcatattcgcacccctatatgaattacagcatttaaagttcaaaatcagtaacttttaatctaggaaattgaaaaatattaagttgcaaagcaaaaaaaggtattttcttgaaaatactatttaatgtttaactagactataggtagttccttaaggttgtttgacctgaagtggagttgggtttggaagctggtgcccagttggtgtggagtgtgtagttttgttatgaaagttctctaccacctacctgtgtgagtgacaccaacatccagatgtcacagctctccagagctagtcagaagagaaatcaaattagtgtttaaacccatttgcatattgacttgtcagtacctttaactcaatttaatataacaagaaatcgtaaaatacttataacctatcttagagaaatgagtgctggttttgagagttgttttttaactgaaagattatttctagatgggtagtgctttgtgctggtttctgcttccatatatttcccagtcattttaattagagaagatactctatggtagaactaaggcctttcctttcttggccaaagtctttaccctatttaaccctttgtatatttctgactgctcactgttcatattataggggaccagatttgtaatatagaattctccataacatgaatgaaattaattctgtccaagccagcatggtggcttcatattaagtagtaacagaagtctgaacaattggataaatttgacttccaagacagctaaacttttcaactgcaattttaaaaactacactacactgttatagttaatctgacaaaaatgtcctcaaagagtactttattttatttaaagcatctgtttaattcaacctttaataattttgcaaagaagggtatgtgtgtattttaatatagcctgacctgaatttatatgtttttagctttagtatttaactttttgtaacaaataaaccttttttaaaacaa

SEQ ID NO: 259 - DNA, 777 bp, Homo sapiens
gcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtcctttttta

SEQ ID NO: 260 - DNA, 1866 bp, Homo sapiens
ccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaa

SEQ ID NO: 261 - DNA, 2343 bp, Homo sapiens
acagtgcggagaccgcagccccggagcccgggccagggtccacctgtccccgcagcgccggctcgcgccctcctgccgcagccaccgagccgccgtctagcgccccgacctcgccaccatgagagccctgctggcgcgcctgcttctctgcgtcctggtcgtgagcgactccaaaggcagcaatgaacttcatcaagttccatcgaactgtgactgtctaaatggaggaacatgtgtgtccaacaagtacttctccaacattcactggtgcaactgcccaaagaaattcggagggcagcactgtgaaatagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggaacccagacaaccggaggcgaccctggtgctatgtgcaggtgggcctaaagctgcttgtccaagagtgcatggtgcatgactgcgcagatggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacacaaggactacagcgctgacacgcttgctcaccacaacgacattgccttgctgaagatccgttccaaggagggcaggtgtgcgcagccatcccggactatacagaccatctgcctgccctcgatgtataacgatccccagtttggcacaagctgtgagatcactggctttggaaaagagaattctaccgactatctctatccggagcagctgaaaatgactgttgtgaagctgatttcccaccgggagtgtcagcagccccactactacggctctgaagtcaccaccaaaatgctgtgtgctgctgacccacagtggaaaacagattcctgccagggagactcagggggacccctcgtctgttccctccaaggccgcatgactttgactggaattgtgagctggggccgtggatgtgccctgaaggacaagccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaagataggctctgcacagatggatttgcctgtgccacccaccagggcgaacgacaatagctttaccctcaggcataggcctgggtgctggctgcccagacccctctggccaggatggaggggtggtcctgactcaacatgttactgaccagcaacttgtctttttctggactgaagcctgcaggagttaaaaagggcagggcatctcctgtgcatgggtgaagggagagccagctcccccgacggtgggcatttgtgaggcccatggttgagaaatgaataatttcccaattaggaagtgtaacagctgaggtctcttgagggagcttagccaatgtgggagcagcggtttggggagcagagacactaacgacttcagggcagggctctgatattccatgaatgtatcaggaaatatatatgtgtgtgtatgtttgcacacttgtgtgtgggctgtgagtgtaagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggggtgaggaccactcctgtacactgaatatttatatttcactatttttatttatatttttgtaattttaaataaaagtgatcaataaaatgtgatttttctga

SEQ ID NO: 262 - DNA, 2605 bp, Homo sapiens
gtgagtcaccaaggaaggcagcggcagctccactcagccagtacccagatacgctgggaaccttccccagccatggcttccctggggcagatcctcttctggagcataattagcatcatcattattctggctggagcaattgcactcatcattggctttggtatttcagggagacactccatcacagtcactactgtcgcctcagctgggaacattggggaggatggaatcctgagctgcacttttgaacctgacatcaaactttctgatatcgtgatacaatggctgaaggaaggtgttttaggcttggtccatgagttcaaagaaggcaaagatgagctgtcggagcaggatgaaatgttcagaggccggacagcagtgtttgctgatcaagtgatagttggcaatgcctctttgcggctgaaaaacgtgcaactcacagatgctggcacctacaaatgttatatcatcacttctaaaggcaaggggaatgctaaccttgagtataaaactggagccttcagcatgccggaagtgaatgtggactataatgccagctcagagaccttgcggtgtgaggctccccgatggttcccccagcccacagtggtctgggcatcccaagttgaccagggagccaacttctcggaagtctccaataccagctttgagctgaactctgagaatgtgaccatgaaggttgtgtctgtgctctacaatgttacgatcaacaacacatactcctgtatgattgaaaatgacattgccaaagcaacaggggatatcaaagtgacagaatcggagatcaaaaggcggagtcacctacagctgctaaactcaaaggcttctctgtgtgtctcttctttctttgccatcagctgggcacttctgcctctcagcccttacctgatgctaaaataatgtgcctcggccacaaaaaagcatgcaaagtcattgttacaacagggatctacagaactatttcaccaccagatatgacctagttttatatttctgggaggaaatgaattcatatctagaagtctggagtgagcaaacaagagcaagaaacaaaaagaagccaaaagcagaaggctccaatatgaacaagataaatctatcttcaaagacatattagaagttgggaaaataattcatgtgaactagacaagtgtgttaagagtgataagtaaaatgcacgtggagacaagtgcatccccagatctcagggacctccccctgcctgtcacctggggagtgagaggacaggatagtgcatgttctttgtctctgaatttttagttatatgtgctgtaatgttgctctgaggaagcccctggaaagtctatcccaacatatccacatcttatattccacaaattaagctgtagtatgtaccctaagacgctgctaattgactgccacttcgcaactcaggggcggctgcattttagtaatgggtcaaatgattcactttttatgatgcttccaaaggtgccttggcttctcttcccaactgacaaatgccaaagttgagaaaaatgatcataattttagcataaacagagcagtcggcgacaccgattttataaataaactgagcaccttctttttaaacaaacaaatgcgggtttatttctcagatgatgttcatccgtgaatggtccagggaaggacctttcaccttgtctatatggcattatgtcatcacaagctctgaggcttctcctttccatcctgcgtggacagctaagacctcagttttcaatagcatctagagcagtgggactcagctggggtgatttcgccccccatctccgggggaatgtctgaagacaattttggttacctcaatgagggagtggaggaggatacagtgctactaccaactagtggatagaggccagggatgctgctcaacctcctaccatgtacaggacgtctccccattacaactacccaatccgaagtgtcaactgtgtcagggctaagaaaccctggttttgagtagaaaagggcctggaaagaggggagccaacaaatctgtctgcttcctcacattagtcattggcaaataagcattctgtctctttggctgctgcctcagcacagagagccagaactctatcgggcaccaggataacatctctcagtgaacagagttgacaaggcctatgggaaatgcctgatgggattatcttcagcttgttgagcttctaagtttctttcccttcattctaccctgcaagccaagttctgtaagagaaatgcctgagttctagctcaggttttcttactctgaatttagatctccagaccctgcctggccacaattcaaattaaggcaacaaacatataccttccatgaagcacacacagacttttgaaagcaaggacaatgactgcttgaattgaggccttgaggaatgaagctttgaaggaaaagaatactttgtttccagcccccttcccacactcttcatgtgttaaccactgccttcctggaccttggagccacggtgactgtattacatgttgttatagaaaactgattttagagttctgatcgttcaagagaatgattaaatatacatttcctacacca

SEQ ID NO: 263 - DNA, 5394 bp, Homo sapiens
actcacacacactcgctcgcacacgcacacactcgatccagcacgcgcgggcggcgcggggcggcggcggccggagtctgcggtgcgaggcgcccccggcccggcgcggcggcggagcccggctggcgggggaggggagggggttgcggagggggcggggtgggggccggagccgcttgagccggcgggagcgggcacccctgcgcgccgcgctcggcctcgcctccgcgccccccgcgcgcccgccgcggtccctcccccgcgcccgtccgctcgccgggcccccgccgccgccccggggtgcagccgagcggccgcgccgggtccccgggacggggtggaagtgggggtggggggaggggatcggggccgggccggggccgcgctgcctgcgatgccgggcgcccgccgcagccgctgccgccggagcccgggatggggcgagaggctgcggcggacgccagcatctccccgccggggaccccgggggccgcggagccgccgccgccgctgctgccgccgttgctgagacccagcgggcgatgggatgaagatgagacgctacaagctctttctcatgttctgtatggccggcctgtgcctcatctccttcctgcacttcttcaagaccctgtcctatgtcaccttcccccgagaactggcctccctcagccctaacctggtgtccagctttttctggaacaatgccccggtcacgccccaggccagccccgagccaggaggccctgacctgctgcgtaccccactctactcccactcgcccctgctgcagccgctgccgcccagcaaggcggccgaggagctccaccgggtggacttggtgctgcccgaggacaccaccgagtatttcgtgcgcaccaaggccggcggcgtctgcttcaaacccggcaccaagatgctggagaggccgcccccgggacggccggaggagaagcctgagggggccaacggctcctcggcccggcggccaccccggtacctcctgagcgcccgggagcgcacggggggccgaggcgcccggcgcaagtgggtggagtgcgtgtgcctgcccggctggcacggacccagctgcggcgtgcccactgtggtgcagtactccaacctgcccaccaaggagcggctggtgcccagggaggtgccgcgccgcgtcatcaacgccatcaacgtcaaccacgagttcgacctgctggacgtgcgcttccacgagctgggcgacgtggtggacgcctttgtggtgtgcgagtccaacttcacggcttatggggagccgcggccgctcaagttccgggagatgctgaccaatggcaccttcgagtacatccgccacaaggtgctctatgtcttcctggaccacttcccgcccggcggccggcaggacggctggatcgccgacgactacctgcgcaccttcctcacccaggacggcgtctcgcggctgcgcaacctgcggcccgacgacgtcttcatcattgacgatgcggacgagatcccggcccgtgacggcgtccttttcctcaagctctacgatggctggaccgagcccttcgccttccacatgcgcaagtcgctctacggcttcttctggaagcagccgggcaccctggaggtggtgtcaggctgcacggtggacatgctgcaggcagtgtatgggctggacggcatccgcctgcgccgccgccagtactacaccatgcccaacttcagacagtatgagaaccgcaccggccacatcctggtgcagtggtcgctgggcagccccctgcacttcgccggctggcactgctcctggtgcttcacgcccgagggcatctacttcaagctcgtgtccgcccagaatggcgacttcccacgctggggtgactacgaggacaagcgggacctgaactacatccgcggcctgatccgcaccgggggctggttcgacggcacgcagcaggagtacccgcctgcagaccccagcgagcacatgtatgcgcccaagtacctgctgaagaactacgaccggttccactacctgctggacaacccctaccaggagcccaggagcacggcggcgggcgggtggcgccacaggggtcccgagggaaggccgcccgcccggggcaaactggacgaggcggaagtctagagctgcatgatctgatagggtttgtgacagggcgggggtggcggcggcccctagcgctatctccctgcctcctgccggctccttggttcttgaggggaccaggagtgggtggggagtgggggtgggggtagggtttccctactgaagcccttgtgaatcaagggtcaggcctttgagctcagaaaatatccctcctgttgggagagggcgcaggccgtgacgtctgggtggcccttatgactgccaagactgctgtggccaggaggtgccactggagtgtgcgtggtggtccctgggtagcgggggagggtaggcaggattggggaagagagcctgcaggatctcaccaggcagcctctggggggtggccaggccgggaaaaagcccaccatttggcatccctgggccttgggctccgtgtgggagaccggcctgccaggaggacccagggctctgtaagtagatgcatttgggtccaggaggaagcgtggacacctcgtagggaagagatgaaaaagccacatcctaccaagaggaggtgctgagggatgctttgcagtgtagtcagaagtgctgggccagatggagacagaactccaccccctgccgcaaaggacaggacctggctgccctgggatgctggtgcctgagtctgtctctgtgcacccctcaggctgtcgtgagccaacacaggggcctggagaaccctgaggagctttccttttggttctaaacccggcgttgacgttccttctccctttcacattgctgtcttgtggactgtgcactcagtccttgcaaggccaagagtccagttgtaggtgtggccttgagggggaagtggggaggagaagactgacatgagtcctctgcacggatccgtctctccctccccatcaccccttccttctgacacccagtcccagctgtccactgtcccaggtgcagtcactgttgtgcccttccttggggcaggctggctgggggccagaaaggggccatgaggctgtcttgggcccaaaaagggacaataaggccagttgtatgcttcctgttcctcatagcttgccttggtggggatgtctttgttggagttgattctgagctgctgtgattaggagaccctgaaatacagtggtttaagcaagatggaagcttgtttctaattagtctagattgagatggcccagagctggtagggcagctctgcgtttcttcatacgcaccttccaattctgggtacacagcggctgctccagcgcccaccctcctgtgtgcatccaagcctgggggaagcagaaatagacaagagggcacacccactttttgctaaaggcatgagccagaattggcaggctcacctctgctggcctctcattggctgggactcagtcacatggccacaagcagctgctagggaacctgggaagtgtagtcttcagcggggccgccatgtgcctggcctcaccttgggagttatcttattgatggaggagaagagaatggatatgggggaccagtagcatctctgggagagggggagggagcagcaataactcagtcgtcggatccagctctcattgtcagagtttccggaacagcttgctcctgtttccctcactgtgcagcccagggctgggggcagtgaggagcttgcagctctgtgggaaggggaaacaccccctcccctcggcccctcagacgctacccaatgatgccggtttgcagagttggcctgtggaatggctcatgtttgtgcgtgtgtgtgtgtatatttatgggcatgggtgcatgcttggtgtgtatttgtacatgtctgtattgctgtgtccctgtaaatacatgcttgtgtatggatggaagaggccaggcccaggcctggcctcttcctcgggcctgtggccacacctcctgcagctccccaaaatgactgaggcagaaagcccttggggagcctagaaagcaaagctaaaggggatgcagggtctgtctgtctgtctgtctttcagtctgaggaatgagaatcctgacctgagggctgtgcagctgagagcccactacctccccagcccctctcggccccagccgcatcatcccacctgtcccctcccccccacctccagtggggctttctccagatgtcttatggttgggggtttcctgatgggccaggagaggagggcatcttcttgcgacagcactgtctgggttaagtgcccagtgagggcatggtgtggggagctggcctcagaggagccgctggtgggcaagcgtgaagtgggctgaggggctctgagccactttgctcccatctaggggactgccccccatggaactcctttgaagtcacagcagccttcctttctgtttgctcttggggctgagaggtggctcaaacactcggggtccctatggctctgggtcaatctaggccaggctgcaccccatggacagggagtctcagggctcctgatcatgcccaggccctggcctggggcctccctccttggcagctttcccacccccacgcccctggcatcctcagttgctatgggatgcccctccagggcaccagctcagggctaagcgaaggaagataggagcagctcagagctgccaggctctgccttcctcacagacctggtggggcaggtcctgttcacagcagcaggagtgaaggcctggccatcggtggagagggcagctgtcagagggctgggggccagggcacaggattgaagagtttcacatatcatcacagcatacactgggaatttggtgggggcagaagaacccagggccactccctcaatatgaagggaaaccaagctgaatgtgaccaccggcacactgctgccatgtcccatgtccacctttctccccgggaataactggccctgagacccctagacccaaggaggcctgtccatgccaagcatccgggaagcatggctggccttatccacccatgggtcacgtcggttcccaggggcagcatgggagatctttgggggcaacagggagagtctgggtggggagacgggacttgtccaagcagaaggcaggaccctgggaaatgcataatgtaaggacatcaataatagtattattttttttgtaagggaaaatcaatatgtacattctgaaatcattttctctgtaaatggttggatttcatttcacccttaaagggatgcttaaaggagaagataatattaataataaaaacagctacaaagtctgaa

SEQ ID NO: 264 - DNA, 3753 bp, Homo sapiens
caaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacgatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagatggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatacagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaatctgaaaaaataaaagtaaagcaagtataaa

SEQ ID NO: 265 - DNA, 1906 bp, Homo sapiens
gcacttcctctccaggaatccgcggagggagcgcaggctcgaagagctcctggacgcagaggccctgcccttgccagacggcgcagacatgtcagaacaaagtaaggatctgagcgaccctaactttgcagccgaggcccccaactccgaggtgcacagcagccctggggtttcggagggggttcctccgtccgcgaccctggcagagccgcagagccctcctctaggcccgacggccgctccgcaggccgcgccgcctccccaggccccgaacgacgagggcgacccgaaggccctgcagcaggctgcggaggagggccgcgcccaccaggccccgagcgcggcccagccgggcccggcaccgccagccccggcgcagctggtgcagaaggcgcacgagctcatgtggtacgtgctggtcaaggaccagaagaagatgatcatctggtttccagacatggtgaaagatgtcatcggcagctacaagaagtggtgcaggagcatcctccggcgcaccagcctcatcctcgcccgggtgttcgggctgcacctgaggctaaccagcctgcacaccatggagtttgcgctggtcaaagcgctggagcccgaggagctggacagggtggcgctgagcaaccgcatgcccatgacaggcctcctgctcatgatcctgagcctcatctacgtgaagggccgcggcgccagagagagcgccgtctggaacgtgctgcgcatcctggggctgcggccctggaagaagcactccaccttcggggacgtgcggaagctcatcactgaggagttcgtccaaatgaattacctgaagtaccagcgcgtcccatacgtggagccgcccgaatacgagttcttttggggctcccgggccagccgcgaaatcaccaagatgcaaatcatggagttcctggccagggtctttaagaaagacccccaggcctggccctcccgatacagagaagctctggaggaggccagagctctgcgggaggctaatcccactgcccactaccctcgcagcagtgtctctgaggactagcaaagtctggaggcagatgaatggtttctgaccctcaccagggctgtggaagggtgggggtgggtcattatagtattcaggatttacagtgcagtattcacgtgtaacttttaagttttcagtacagtgcttttatacctttaatgcaatgttgtattcatttgggtactattgtgtagtatttaggatgtatgcatgtttgtttatatgtaagcttggttggtgctttcgcttttgtgctacctttcttggatttttgtaccagagatgtgctaaactgatgaaatacattgagaaagtttccatcttattcttttatatgggactgatgatgtgtgttggggtagactgctcctgcagagtttggaagaagtcaccagcaaagccggcctaaccaagaaaagtcaaggcccttcatgaccttgctgggcacagaaaacaccctcgtggagtacactaatttgaactggactggtctcagtgtgagcacttggcacactttactaaacacatatacaaccccaccgtgagtcaactttaaagtaaacattaaagattcttgtgatacaatcatttttggaaaagtgtactttatcattttaacaaagcagtatggttgggaatgagacaattctctattttacagtgtatacagatacaactatttcccctaatagggtgggaaaaatcgctactcatgattactcctaaatttgtgaagtttatagttctattgtctttaaatgtaactcatgtttatttcaaaaacattcacaaatatagaaaagtatacaaaacaaaacagtaagattgtctgtaatcacatcatatgggaataaaaaacaaaaataa

SEQ ID NO: 266 - DNA, 1837 bp, Homo sapiens
agacggtgctggtgactcgtccacactgctcgcttcggatactccaggcgtctcccgttgcggccgctccctgccttagaggccagccttggacacttgctgcccctttccagcccggattctgggatccttccctctgagccaacatctgggtcctgccttcgacaccaccccaaggcttcctaccttgcgtgcctggagtctgccccaggggcccttgtcctgggccatggcccagaagggggtcctggggcctgggcagctgggggctgtggccattctgctctatcttggattactccggtcggggacaggagcggaaggggcagaagctccctgcggtgtggccccccaagcacgcatcacaggtggcagcagtgcagtcgccggtcagtggccctggcaggtcagcatcacctatgaaggcgtccatgtgtgtggtggctctctcgtgtctgagcagtgggtgctgtcagctgctcactgcttccccagcgagcaccacaaggaagcctatgaggtcaagctgggggcccaccagctagactcctactccgaggacgccaaggtcagcaccctgaaggacatcatcccccaccccagctacctccaggagggctcccagggcgacattgcactcctccaactcagcagacccatcaccttctcccgctacatccggcccatctgcctccctgcagccaacgcctccttccccaacggcctccactgcactgtcactggctggggtcatgtggccccctcagtgagcctcctgacgcccaagccactgcagcaactcgaggtgcctctgatcagtcgtgagacgtgtaactgcctgtacaacatcgacgccaagcctgaggagccgcactttgtccaagaggacatggtgtgtgctggctatgtggaggggggcaaggacgcctgccagggtgactctgggggcccactctcctgccctgtggagggtctctggtacctgacgggcattgtgagctggggagatgcctgtggggcccgcaacaggcctggtgtgtacactctggcctccagctatgcctcctggatccaaagcaaggtgacagaactccagcctcgtgtggtgccccaaacccaggagtcccagcccgacagcaacctctgtggcagccacctggccttcagctctgccccagcccagggcttgctgaggcccatccttttcctgcctctgggcctggctctgggcctcctctccccatggctcagcgagcactgagctggccctacttccaggatggatgcatcacactcaaggacaggagcctggtccttccctgatggcctttggacccagggcctgacttgagccactccttccttcaggactctgcgggaggctggggccccatcttgatctttgagcccattcttctgggtgtgctttttgggaccatcactgagagtcaggagttttactgcctgtagcaatggccagagcctctggcccctcacccaccatggaccagcccattggccgagctcctggggagctcctgggacccttggctatgaaaatgagccctggctcccacctgtttctggaagactgctcccggcccgcctgcccagactgatgagcacatctctctgccctctccctgtgttctgggctggggccacctttgtgcagcttcgaggacaggaaaggccccaatcttgcccactggccgctgagcgcccccgagccctgactcctggactccggaggactgagcccccaccggaactgggctggcgcttggatctggggtgggagtaacagggcagaaatgattaaaatgtttgagcacaa

SEQ ID NO: 267 - DNA, 2560 bp, Homo sapiens
agtcggtctcgccgcgctcgccgggtgtcccagtgtcaccaacactcggccgccgccgccagcttggcgcgcaccgccgcctccgccaccgccgacagcgcgcatcctccgtgtccccgctccgccgcccgagcaggtgccactatgcacgtgaagaagtacctgctgaagggcctgcatcggctgcagaagggccccggctacacgtacaaggagctgctggtgtggtactgcgacaacaccaacacccacggccccaagcgcatcatctgtgaggggcccaagaagaaagccatgtggttcctgctcaccctgctcttcgccgccctcgtctgctggcagtggggcatcttcatcaggacctacttgagctgggaggtcagcgtctccctctccgtaggcttcaagaccatggacttccctgccgtcaccatctgcaatgctagccccttcaagtattccaaaatcaagcatttgctgaaggacctggatgagctgatggaagctgtcctggagagaatcctggctcctgagctaagccatgccaatgccaccaggaacctgaacttctccatctggaaccacacacccctggtccttattgatgaacggaacccccaccaccccatggtccttgatctctttggagacaaccacaatggcttaacaagcagctcagcatcagaaaagatctgtaatgcccacgggtgcaaaatggccatgagactatgtagcctcaacaggacccagtgtaccttccggaacttcaccagtgctacccaggcattgacagagtggtacatcctgcaggccaccaacatctttgcacaggtgccacagcaggagctagtagagatgagctaccccggcgagcagatgatcctggcctgcctattcggagctgagccctgcaactaccggaacttcacgtccatcttctaccctcactatggcaactgttacatcttcaactggggcatgacagagaaggcacttccttcggccaaccctggaactgaattcggcctgaagttgatcctggacataggccaggaagactacgtccccttccttgcgtccacggccggggtcaggctgatgcttcacgagcagaggtcataccccttcatcagagatgagggcatctacgccatgtcggggacagagacgtccatcggggtactcgtggacaagcttcagcgcatgggggagccctacagcccgtgcaccgtgaatggttctgaggtccccgtccaaaacttctacagtgactacaacacgacctactccatccaggcctgtcttcgctcctgcttccaagaccacatgatccgtaactgcaactgtggccactacctgtacccactgccccgtggggagaaatactgcaacaaccgggacttcccagactgggcccattgctactcagatctacagatgagcgtggcgcagagagagacctgcattggcatgtgcaaggagtcctgcaatgacacccagtacaagatgaccatctccatggctgactggccttctgaggcctccgaggactggattttccacgtcttgtctcaggagcgggaccaaagcaccaatatcaccctgagcaggaagggaattgtcaagctcaacatctacttccaagaatttaactatcgcaccattgaagaatcagcagccaataacatcgtctggctgctctcgaatctgggtggccagtttggcttctggatggggggctctgtgctgtgcctcatcgagtttggggagatcatcatcgactttgtgtggatcaccatcatcaagctggtggccttggccaagagcctacggcagcggcgagcccaagccagctacgctggcccaccgcccaccgtggccgagctggtggaggcccacaccaactttggcttccagcctgacacggccccccgcagccccaacactgggccctaccccagtgagcaggccctgcccatcccaggcaccccgccccccaactatgactccctgcgtctgcagccgctggacgtcatcgagtctgacagtgagggtgatgccatctaaccctgcccctgcccaccccgggcggctgaaactcactgagcagccaagactgttgcccgaggcctcactgtatggtgccctctccaaagggtcgggagggtagctctccaggccagagcttgtgtccttcaacagagaggccagcggcaactggtccgttactggccaagggctctgtagaatcacggtgctggtacaggatgcaggaataaattgtatcttcacctggttcctaccctcgtccctacctgtcctgatcctggtcctgaagacccctcggaacaccctctcctggtggcaggccacttccctcccagtgccagtctccatccaccccagagaggaacaggcgggtgggccatgtggttttctccttcctggccttggctggcctctggggcaggggtggtggagagatggaagggcatcaggtgtagggaccctgccaagtggcacctgatttactctagaaaataaaagtagaaaatactga

SEQ ID NO: 268 - DNA, 4218 bp, Homo sapiens
atgctccgctgcaggcccgcgcccgcgcccggactttgccatcggcggggcagtcgcgggatgcgcccgggagccacagcctgaggccctcaggtctctgcaggtgtcgtggaggaacctagcacctgccatcctcttccccaatttgccacttccagcagctttagcccatgaggaggatgtgaccgggactgagtcaggagccctctggaagcatggagactgtggtgattgttgccataggtgtgctggccaccatctttctggcttcgtttgcagccttggtgctggtttgcaggcagcgctactgccggccgcgagacctgctgcagcgctatgattctaagcccattgtggacctcattggtgccatggagacccagtctgagccctctgagttagaactggacgatgtcgttatcaccaacccccacattgaggccattctggagaatgaagactggatcgaagatgcctcgggtctcatgtcccactgcattgccatcttgaagatttgtcacactctgacagagaagcttgttgccatgacaatgggctctggggccaagatgaagacttcagccagtgtcagcgacatcattgtggtggccaagcggatcagccccagggtggatgatgttgtgaagtcgatgtaccctccgttggaccccaaactcctggacgcacggacgactgccctgctcctgtctgtcagtcacctggtgctggtgacaaggaatgcctgccatctgacgggaggcctggactggattgaccagtctctgtcggctgctgaggagcatttggaagtccttcgagaagcagccctagcttctgagccagataaaggcctcccaggccctgaaggcttcctgcaggagcagtctgcaatttagtgcctacaggccagcagctagccatgaaggcccctgccgccatccctggatggctcagcttagccttctactttttcctatagagttagttgttctccacggctggagagttcagctgtgtgtgcatagtaaagcaggagatccccgtcagtttatgcctcttttgcagttgcaaactgtggctggtgagtggcagtctaatactacagttaggggagatgccattcactctctgcaagaggagtattgaaaactggtggactgtcagctttatttagctcacctagtgttttcaagaaaattgagccaccgtctaagaaatcaagaggtttcacattaaaattagaatttctggcctctctcgatcggtcagaatgtgtggcaattctgatctgcattttcagaagaggacaatcaattgaaactaagtaggggtttcttcttttggcaagacttgtactctctcacctggcctgtttcatttatttgtattatctgcctggtccctgaggcgtctgggtctctcctctcccttgcaggtttgggtttgaagctgaggaactacaaagttgatgatttcttttttatctttatgcctgcaattttacctagctaccactaggtggatagtaaatttatacttatgtttccctcaagtgtgtagttattgagtcaaattcatatgcatggtgtattgtgggacatacttagatggaaggagagagcctaagaatcctgaggatgatttctgtgtatgcctcaaaatgagatatttaggctgggcgcggtggctcacacctgtaatcctcgcactttgggaggctaaggtgggtggattgcttgagcccaggagtttgagaccagcctgggcaacatggtgaaacctcatctctacacaaactacaaaaattagctgggcatggtgacacgtgcggctgcttggtaggctgaggtgggaggatcgcttgagcccaggaggtgaaggttgcagtgagccctgattgtgccactgcattccagcctgggcgacagagtgagaccatgtctccaaaacatacatatatataaaatatatttaaagacctcttggagttcaggcagaagtgaagatagcactatgaagtagtttccacattaacaatagcaatgacttgaacgatgtgttccccctttcttctgatattaatatctgttcattttgcaaacattgaaagattatgaaagctatgacccagaatcacaattatataatttggatacatacccaaatggcataatttctgtcataagcctgtaggaaaagcttgaattcttcacttctcagattctcagagccagcttgctcttgggagaggggcctggtataggggctgcccaggttcgtagcctatgctgtcaagcatgtttggagttgcacatctgttcccatgtcattttctctgtctaactgaagtcagaaaattcctcagctggattctggggaaccaggaacccatattcccaaatccaagattgggacctggtttgtctttccatttgggcacatttcattctttccaggaaaacaggccacttccaacctgcacaatgtacaccaaaccacagaaccacagctgggatatggagtcaggagagggaagctggagctcaactctcatggactaaaggatggattctggatgggctccaggggacaccttattggattggtggcttccatcaactcttaaaaacgttaagtggtgaactttcccgtcctgtcaagctgtgaatggggaatgtatacaaagtcactttgacttttctatttgaggcctccacagtaaacatccagagtcatcctatttttgtctttttacctccctttcagaacctgttttcgtaattagactggaaagcaattcatgctaagtttgcaatggctgccacagttgtaagtgtcccctgcattttaacctgcactagagccctaagccacagagaagcagttctgaattggtatctcaaataccatccacctggtgtgggtctgcagggtggagagctttcccagcacccctgaagcaatgcccaatgtcgattaccttctctgagtcctggcaagtcctggcacattggctttctggatcccttagatgctgccctttctgttgtgaggagaggttgccgaagatattggaggtgtctgctggactgtaggatttctgatcccactgctgtgtagtttttttttctagtgctggacaagtaagaagcctctggataaatttggtgttggtggctgatggttgaagtggaagcagtctttggggtaggaggcaatgccactcctctaggcccttcgggagttggctgaagttacttcctcccttggaaggggctggttagtgagtgccagggatctcaggactgtctctgtgccaggtgtggtttcccaggcaacagacacattcctaagtgcctagttctctagcgtctgtatacatggtagtagagccttccttccatgtctctcttccctctggcctggaataggagcattagactcaaattctgatgaaaaagaaattacttggagatagagattcaatgtgaagagaacaagatatttgaagtcagaattaggtttgaatttgggctcagtgacttacagtgtgagcttggtcaagttcttaacattctggtccttagcattctcatctgtatggtcaaggctattgtcattgggttggtatgtcaacaagcaaaacggtatgtgtgagctgcccaattgtgggcctggttctgattagccaatgttaacacccttctctccacagcttcccattctctgatgccgctgacccagatggcgtcacctcagttaccatggcttggtccaagcagtgacttctgttcatgggctctggaattgagtggccaaaaatctggaatccctacagtagggagagtagccttgtccctgccccactacaagtctgttcatatgaagacatacaaagccgtcgcctctaatcagtgttcaaagggtcgattgtgcaactcacattcctccagagaaattcccccagcttgtgagatctccaagagggaacacgtattcctggcatccaacttcccctggtgctccccctgacctgcctcattccaggagttccctctccagagaccctgtgtgcccacacgagcagacttttagaaaatggcctacagttcaaaggccctgcattgctttatggccttggaaatgtggggaaagtgtcagatgaagaatttctatcctcctcacctcctccctgtctccaataaatgcataccaaga

SEQ ID NO: 269 - DNA, 4436 bp, Homo sapiens
agtagtgaatcgtagcatgttagagttagaaggttcagtgttgatggagttattgaagaaatgatggagtaagagactcttttctaagcaactcaagtttgcagtgattcaggcctacttctgaagagacagccttttatctcaatgaatgacacagaaaaaccagcagatactccctctgaggaagaggactttggtgatccaaggacatatgacccagatttcaaggggcctgttgccaacaggagttgtacagatgttctgtgctgtatgatcttcctactgtgtattattggctacattgttttaggacttgtggcctgggtacatggggaccccagaagagcagcctatcctacagacagccagggccacttttgtggccagaagggcactcccaatgagaacaagaccattttgttttactttaacctgttacgctgtaccagtccctccgtgttgctaaacctacagtgccctaccacacagatctgtgtctccaagtgcccagaaaaatttttaacctatgtggaaatgcaacttttgtacacaaaagacaaaagctactgggaagactaccgtcagttctgtaagaccactgctaagcctgtgaagtctctcacacagcttttactggatgatgattgtccaacagcgatttttcccagcaaaccttttctccagagatgtttccctgacttctctaccaaaaatggcactttaacaataggaagtaagatgatgtttcaagatggaaatggagggacaagaagtgttgtagaactcgggattgctgcaaatggtatcaataaacttcttgatgcaaagtcacttggattgaaagtgtttgaagactatgcaagaacttggtattggattctcattggcctgacgattgccatggtccttagttggatatttttgatacttctgaggttcatagctggatgcctcttctgggtcttcatgattggtgtgattggaattataggttatggaatatggcactgttaccagcagtacaccaatcttcaggaacgcccaagttctgtattaactatctatgacatcgggattcagactaacataagcatgtactttgaactgcaacaaacatggttcacatttatgataatactctgcatcattgaagtgattgtcatcctcatgctgatcttcctcaggaatcgaatccgagtcgccattatcctgctgaaggaaggaagcaaagccattggatatgttcctagtacattagtctatccagctttaactttcattttgctctcaatctgcatttgctactgggtcgtgacagcagttttcttggcgacatcgggggtacctgtatacaaagtcatagctccaggggggcattgtatacatgaaaatcaaacctgtgacccagagatttttaatacaactgaaattgccaaagcttgccctggggctctgtgtaactttgctttctatggtggaaagagcttgtaccatcagtacatccctaccttccatgtatacaacttatttgtctttctctggcttataaacttcgtcattgcattaggtcagtgcgcccttgctggtgcattcgctacttattactgggccatgaaaaaacctgatgacatcccacgatatccactttttactgcatttggacgagccatacgatatcacacaggatccctagcatttggatctttaattattgcattaattcaaatgtttaaaattgtactagaatacttggaccaccgtcttaaacgtacccagaacacattgtctaaattcctacaatgctgcctgagatgctgcttctggtgtttggaaaatgcaataaagtttttaaacagaaatgcctatattatgattgcaatatatggcagaaacttctgcaggtcagcaaaagatgctttcaatctgctgatgagaaatgttttgaaagttgcagttacagatgaagttacatactttgtattattcctggggaaacttctagttgctggaagtataggtgttctggccttcctattcttcacacaaagactgccagtgattgcacaaggaccagcatctttaaattactactgggtacctttgctgacagtcatttttgggtcttacctgattgcacatgggttcttcagcgtctatgcaatgtgtgttgaaacaattttcatctgcttctgtgaagatctggaaagaaatgatggatctacagaaaaaccctacttcgtaacccctaacctgcatggaattctgatcaagaagcaactagttccccagaagcagaaagagtagaaaagctccaaacagtgtcactcatttttaagtagaagttgtgtaaattaggttgattgtaatttggaaatgttgcttttgagtaatgtgaaatttctgtgcttaattctaagaagtcagcacctggtactacctgaggtgtcaggtatttgatgacattagctgctgtctactttatagacagtggtcccagctaaagatcaaaatgttaatgtcaaacgttttttaaaatctgtagccgagagtgttttaataacttttataactcagcgtgctgtttccattgcagcactttaatagcctttctttttataagtgtatatttgtaaaggatattcaggcaatttttgaaaacactataaatgtgtaattaattagccataaaatattgatttatagttaaccagcatatggtactaaatttgtaaatatggtgctatggttatatttatactgttcaagctggtggacaactctctaaactgtgattaaacttgtattaatggttccctaggaagtatatttcagtgagtcatgtccataacaaacatagatgttaatgttatataggttctacggagagcattactgggtaaaaaatactatggaaccttcagagcccattctgttttagtgaaatcatgtttatattgaagtcgaatctgagttctggagtgtcatttccaacaacatgaacctctgtccatggtgaaaatattctgaacaaaactgaaattgttacataactcatgccttttgtctttaacccaaatttcttattcccactatatagaaaatcaatatgaatttgtttcagaagagtgattatatcttttcatgagtatacctgtatttctagattaaagagattgtgtggctttgttctacagaaggtttgattttgtctcacctttcagtgaggaaagagaaaagaaagacacttcagattttaccctaaggaaatatactgttggcgctccatcatctaatacctttatgaggggcatactgtgggttaggaactctctctctgcagggcttaggaggaaagttgttgccacctgccaccgctggccgcctgaggtttctgatagtcatgtgtaagttttgaatggcagaacaaagcatgaatcagacacacatcttgcctagccatcccctgtgtgcaaatgtgtatgatgtggttaaccatgtaaaaatgcaccccaaaaggagcattgaatcaatttgtattttcttggcttttaccttaaacttgtatataaggattatttatatattgacagaaaggaacatgttgatctgaatatcactcatatatccaagaaaagagtcagaaatgtattgttgtgttatagattgatctaaatacgtattaattatcttcaagtgtagacacctagatttaaactgactctgtggcagattaattaatagcaataagccaatgaatagggaagatttttaatatataatgactaccagcttgttcttggcttacattcttgagattattgtattcaaaagtgtcagttggcttcacattttggcaaagagccttctgcattcttattctccttgaagcataatgcagataatgacaacttatctttctagattagtcttttattattcaacaagacaaaggccacaacaaaggactagtagaatagtgacctctacctgagaatttgttataactatagatgtttgtgctctgcccaagagattctgatatactgtgatttgatgtgagccacgatgtgaattattataaagttctctagttgattctgatacacataaaagttgaaaaattggccatgtgtggtgtctcacgcctgtaatcccagcactttgggagtccaagatggacagatcactggagcctaggagttccagaccagtctaggcaacatggtgaaaccccatctatctttataaaaaatataaaagttagccaagtgtggtggtgcacacctgtagtctcagctacttgggaggctgaaatgtgagggtcacttgagcccaagagatcgaggctgcagtgagccatgatcacaccactgcactccagcctgggtgacagagcaaaaccctgtttaaaaaaaaaaagttgaaaaaatcacttg

SEQ ID NO: 270 - DNA, 3696 bp, Homo sapiens
gtccagcatttcagcaagcggcggcagcacccgcggggaggcagagggtgcggggccgtgggggccgcggagctgccctgcccaactcagcccagactaggcggcagcccggaccggcgggacccgagggcctggccccagcgcccggtagatcgcggcggtcagcggtgagggccagcggcccaggccagcggctccagggccagccacgatgtcctccaccgtgaacaacggggcggccagcatgcagtccacacccgacgccgcgaacggcttcccgcagcccagctcctcctcggggacctggccgcgggcggaagaggagctgcgcgccgcggagccgggcctggtgaagcgcgcgcaccgcgagatcctggaccacgagcgcaagcggcgggtggagctcaagtgcatggagctgcaggagatgatggaggagcaggggtattcggaggaggagattcggcagaaagtggggacattccggcagatgctgatggagaaggagggagtgctcaccagggaggaccggcctgggggccacattgtggcggagaccccgcggctgaccgagggcgctgagccgggcctggagtacgcgccctttgacgatgacgacggcccagtggactgtgactgcccggcctcctgctaccgcggccaccgcgggtacaggaccaagcattggtctagcagctcggcatcgccccctcccaagaaaaagaagaaaaagaaaggcggccaccggagaagccgcaaaaagaggagactggagtccgaatgcagctgtgggagctcctcacccctccgcaagaagaagaagagtgtgaagaagcatcgccgagacaggtctgattctgggtcccggaggaagagacggcacagatctcgaagctccaagtgcaaaagaaaagagaagaacaaagagaagaagaggcctcacacagagtccccaggccggaggtctcatcgccatagcagtggcagctcccacagcccctccctctcctcccactacagtgattccagatctcccagcaggctgagccccaagcaccgagacgaagggcgaaagacgggcagccagcggtccagcggaagccggtcgccttccccgtcgggcggcagcggatgggggtcgccccagcggaacggcggcagcgggcagcggagcggagcgcacgggggccgccccggctcggcgcacagcccgcccgataagcccagctcgccctcgcccagggtccgtgacaaggcggcggccgccgcacccacgccgcccgcgcgggggaaggagagcccgagcccgcgctcggcgccgtcgtcccaaggtcgcggaggccgcgcggcgggcggggcgggcaggcggcggcggcggcggcgtaggcggcggcgctcgcggtcctcggcgtccgcgccccgccgcaggggtcgccggcgcccccggcccgcgcccccccggggctcgtcgcgctcgctcagcagggcccgctccagcagcgactccggcagcggccgcggcgcccccggccccgggcccgagcccggctctgagcgaggccacggcggacacgggaaacgggccaaggagcggcccccgcgcgcgcggcccgccagcacctctccgtccccgggcgcgcacggccggcgcggcggcccagaagggaagagctcgtcgcgcagccccggcccgcacccccgctcctggagctccagccgctcgccctccaaatctcgctcgcgctctgcggagaagcggccccacagccccagccgctcgccgtcgcccaagaagcccctcagccgggacaaggacggcgagggccgcgcaaggcactctgaggccgaggccacccgcgcccggcgccgctcccgcagctactcgcccatccgcaagcggcgccgggactcgccaagcttcatggagccgcggcgcatcaccaggtccagcctgctgagtggcctgtggtcagcctgggggccaggcggacccctctgcacaggctgcctgggagatgcccaacgcccgcaagcgtcctattccatactaccggcccagcccctcttcctcctccagctgcttgagcagcgactactcgacccggagccacagccgcagccccagccccggccacagccacgggagctacagcagtcgcagccatgggacccgcagccggacacgcagcccctcgaggacccccagtcccagctaccacagccggagcagctctgagagcgggggcttctgagcccagacagactcagcttggtgcccccctggcactgggagaggcgaggggcgggccccaggaccccagtggggagggggctatatctccttgcccccaaggctacaaagaggtctcagggccagtgcacgggcagatgggaccggggaagactttgagggtgggcatccagtggacaaggagaagccagatgtgctgcttctacgggtgtcctctcccacctcctgtccacccactgtgcccggggaacaaagagccgttacgaacacaggaatctccccatcccccttcctgctgatgccaactcaccaggcttgggactgctgccggtggatggtaccagagtccatgatctgctctgtcacttcaccttagctcagtgcagccagggacaccttgcaaggtgccagccctgggagcccctcttccgcactacacagctccctccactcctctcttatcactgggcagacgaggaggtggtacagcacatgggtttggagctagacagaaggaagaacagcctaacccttggtgcacccccatccaagctggggagctgcatccttttgagctggctgcaggaggaccctggctgagggctggtggctggccccacagcctcccccaagctcctccactgacccaggagtgcccagacgggtggcccccaaaatcccagcctggggagctaggcacctcactcttggtctgacctctccaggccaggctctcctcaccccatgccctgggccaaggtcctaccagccatgactactgcatgacaagaggtggggggtacagacctcaggtacatttgaccctgaggttaaaaggggttcaggtcaagaggtgggagaggaaaggggtagatgggaggtggaatctgtaggaaagagaaaaagcaaagtcgttcactgactgagtagcccccagggagtggagacgggtccctggggagggagcagctgacaggtcagcagtgcccccagccccacccaagaggagggcagcgtgtgcctgtggtctgggacgtgggctggatggcagcccagggtcacaggcataggataacatgtgctttggacctgacaagggagtaccttgggggtctgatggggtcatggccagccgagcctctgtagagatggaggctacagccctcagaagggaggggaggaaagagactgagggccctggcctggggcgtcgatggggaagcggtggcccccagtcctcttctgctgctcccagccccctcctcctggggccctcagggatctcatgaagtcttccttggcccaaccaggcagatgccccgggctccagtggggggaggggtctggggtctggtccgggttccccgctttctctatgtcccccctccctctttctccgcagtgcggataaaaattggactcgaataaaacccttggtgcccgga

SEQ ID NO: 271 - DNA, 2082 bp, Homo sapiens
accgtcagggacgcggactcgggagtgcgcacattcgcagcccgggcagccctgctgcgcaccgggcctcgcgccccgcgccccgcgccccgcgccccgcgccccgcaccggcctccaggatcatgtggtatgtcagcaccaggggcgtagccccacgggtcaactttgagggggccctcttctctggctatgcacctgacgggggcctctttatgcctgaagagctcccacagttggacagagggaccctgtgccagtggagcacactctcctatcctggcctggtgaaggagctgtgtgccctcttcattggctctgagctccttccaaaagatgaattaaatgatctgatcgaccgagccttcagcagattccgtcacagagaagtggtccatctgtccaggttgaggaatgggctgaacgtgttggagctgtggcatggcgtcacatatgcatttaaggacctgtccctgtcctgcacaacacagttcctgcagtacttcctggagaagagggagaagcacgtcactgtggttgtaggaacatctggggacacaggaagtgctgccattgagagtgttcaaggggcaaagaacatggacattatcgttctgctgcccaaaggtcactgcacaaagattcaggagctccagatgacaacggtgctgaagcagaacgtacatgtgtttggagtggagggaaacagcgatgagctcgatgagccgatcaagactgtgtttgccgatgtggcttttgtcaagaagcacaatctgatgagcctgaattcgatcaactggtcccgggtcctggtgcagatggcccatcacttctttgcttacttccagtgtacgccatccttggacacacatcccctacccctggtggaggtggttgtgccaacaggggctgccggtaaccttgcagctgggtacattgctcaaaagataggcctgcccatccgtctggtcgtggcagtgaaccgcaatgacatcatccacaggactgtccagcagggagacttctctctctctgaggctgttaaatcaaccttggcatcagctatggacattcaggtgccctacaacatggagagggtgttctggctgctctctggctctgacagccaggtgacaagagccctcatggagcagtttgaaaggacccaaagtgtgaatctgcccaaggaactgcacagcaagctttcagaggcagtgacatccgtgtcagtgtcggatgaagccatcacccagaccatgggccgctgctgggatgagaaccagtacttgctgtgcccccactcagcggtggccgtgaactaccattaccagcagatagacaggcagcagcccagcactccccggtgctgcctcgcccctgcctctgcagccaagttcccggaagctgtcctggctgctggcctgacccctgagactcccgcggagatcgtagccctggagcacaaggagacacgctgcaccctgatgcggagaggtgacaactggatgctgatgcttcgggacaccattgaggaccttagccgacagtggaggagtcatgccctcaacacctcccagtagcctggctggaggtggctttctttaggcttcagatcccaggaagatgcaccttctgagctgccttgtgcaccctccccattaagcgtaggttaggaggtttccgggaggctgctcagctggatctggagccagctggctttgctccgttccctggctagtctgtgcctggtcaccagggaggctgagtgaggggctgtgaacagttgccggaagcaccccctccctccccggcccgtgcagcagtgtctgagctgtagtgaaagtttcagggcctgcaaaagaagaggcttgggcacaggactgaccatggctccaggggtttaggaccccagacctgtgaaggtgggagcagctcaccaccttcacgcaggctttgtatgttctctgagccttagttgattttggcccccaaaccaaatccaaaggttctggcccaccttgtcagaggcttccaccctgctcacatgttgggaatccctggaataaaatgcttgttcagtgtga

SEQ ID NO: 272 - DNA, 2724 bp, Homo sapiens
acattgtgtctattgtatcccttggctggtgtatttgtacatctctcgggacgtgaaattgacagtgaaaagtatggcagatgagcaagaaatcatgtgcaaattggaaagcattaaagagatcaggaacaagaccctgcagatggagaagatcaaggctcgtttgaaggctgagtttgaggcacttgagtcagaggaaaggcacctgaaggaatacaagcaggagatggaccttctgctacaggagaagatggcccatgtggaggaactccgactgatccacgctgacatcaatgtgatggaaaacactatcaaacaatctgagaatgacctaaacaagctgctagagtctacaaggaggctgcatgatgagtataagccactgaaagaacatgtggatgccctgcgcatgactctgggcctgcagaggctccctgacttgtgtgaagaagaggagaagctttccttggattactttgagaagcagaaagcagaatggcagacagaacctcaggagccccccatccctgagtccctggccgctgcagccgctgccgcccaacagctccaagtggctaggaagcaggatactcggcagacggccaccttcaggcagcagcccccacctatgaaggcctgcttgtcatgtcaccagcaaattcaccggaatgcacctatatgccctctttgcaaggccaagagtcggtcccggaaccccaaaaagccgaaacggaagcaggatgaataaagaaagggagagcacatgaagctttgctaattataacccctcaccttgaccagagtcattgatgtcctgatgtgaaacaacccttgcccaaccccacgaagtctcctatttaatgtgatggaagcacaacccctctctcactttgctcctatttctttctgctcttgggatttctggtttaggaagagatgtggttcaggtgctaaacagtgtgtctgatgatcccttctctcccactcacatttcaacccctgcccttgtttggagctaagggaagggcaaaaggctcagatatgattctctatctcttgtgcctgaggcctggagcctaaggagctgtagggtctgaggggcaggggaggcccatatcttgtttcaggtaaaggacccagtatttcccctccttgtacttttgccttaggttctcaagggacaatagtcttcatgttggattctccaacaggctgggtgcatgtatccccctactcctaccctcatctcatccttaaggcccagaggtagcttggacaagccctccttttcataatcatttgggaggcatggctgtaattctttagctttctccacttctgtctcccacatatactaaaattcttaggtactaggctgtgtgtcttgggatcttaagatcaatgaacctttccccaatatctagtctttgcaaattctagtagaagatttccacagtgaaatcagtgagccagaccaactctacatctcctgcctaacctactgcctaagtcattagggctgagggctcggctgtaggggcttccttaggctgagagtgcccccaggctgacatctgtgttggcttttgttcagaaccattactctggcacatgctcaatggtatattgcagggaggagaggagtagatttagatttgagtaaatgccaatcactttacacatgaaggtgggtgggactttccttccattcatcccttgctctcttggatctgaactcttctggagcctcagctcaggatagctgctggccactcctgtcctgtggattgtgcaggtggcctttcctcccaaaagaaaaggcatcaggctccccaagccccacagctctcctttccaccaaagccaggtttcctggtaaggtcactcgaagataagggatggggatgggggctgactgacaaaaaattttagccccaggtctcagtacctggctggggagggggatatttttccttccttaagtagttttacattgccacagtgtgtatgtgttcactatataaaatgttcctctgctctttgaaagtaagagtgttgtgtctgtacaaatccttttaacatgcattcattggagtaaattctgagtatctactgtgtattggataatacaaaagatgtaatgtcatttacctttctgggtagctcttgtttgctcttattcattccaccttacaaatgagaaagccaggcaccaaggacaataatttacctaattatcacaataatttccatttatttagcacctactctgtgccaggtacctatgcaagttgcttaatataaatgattgtatttgacttccaaaataccttacaagctaagtattcttatcaccattttaaaaaaaaagggatactgaacctccaaaaacttaaaagctttttcagagttaaacagctagtaagaggaaattgcaggatttggagccagctttgtccaactccagagctcatttttttctacttcttctccatgatcatttttaagaaaacctttctccctttcagaatggcttgatgatgagagtggttgaaataactttggaactgaaatcaagaactgggtgtcaaatgactgattcagggatataaaggccaagggctctctaaataatatcctgtacactaatctgtctctgtgcttgtcagggaattcaacagctaaataaaacctctctgtgcctcagtgtcctcatctggaaaa

SEQ ID NO: 273 - DNA, 2346 bp, Homo sapiens
agtgctgctcttttccccagtgttttcggagggatgacgggggatggtaggggttggcctctgtctgcgactgttactgttctttcgttttaaacgaacgctggacaggatttgcgtgctcttcctcctcgggtggcatcggaagccgcgcagtgatggatctctctttatagagaggttatacattggctcttcaaagacgttcacctcatcagagaaatccctgactcctttgcagtggtgtagacatgtcctagataacccaactcctgagatggaagcagcgagacgttccctgtgctttagactggagcaaggttacacttccaggggctccccactcagtccccagtcatctatcgacagtgagctgagtacttcagaattggaggatgattctatctccatgggatataaattacaggacctcactgatgttcagatcatggctcgtctgcaagaagaaagtctcaggcaagattatgcttctacttcagcatctgtatcaagacatagttccagtgtgtcattgagttcaggaaaaaaagggacatgtagtgatcaagaatatgaccaatacagtctggaggatgaagaggaatttgatcatttgccaccacctcagcctcgtcttccaagatgttcccctttccaaagaggaattccccattcacagactttctccagcattcgggagtgtaggaggagccccagttcccagtattttccttcaaataattaccagcagcaacagtattattcacctcaagcccaaactccagatcagcaaccaaataggaccaatggagataagctccgaagaagtatgcctaacctagcccggatgccaagtacaactgccattagtagcaacattagttctccggtcaccgtgcgaaatagtcagagttttgactcaagcttgcatggagctggaaatggaatttcaagaatacaatcttgtattccatcaccgggacagcttcaacacagggtccacagcgtggggcatttcccagtgtctatccgacagcctcttaaagccacagcctatgtgagtccaaccgttcaaggcagcagtaacatgcctttatcaaacggcttacagctgtattccaacacaggaatccccacaccgaacaaagctgcagcttctgggataatgggtcgcagtgcactcccaagaccttcgttggcaataaatgggagtaacctgcctcgaagcaaaattgcacaacctgttagaagttttcttcagcctccaaagcctctgtcttcactcagcactctgagggatggaaattggagagatggttgctactaatgcagttttatgtacccttgaaaaatgggaaagaagtaaaaatgagggttgtgttacctagctggctgggtagcagtggatgttgggatattctttcccttttgtgttttaatatatttactgcattgtttctcaatggaccagtcaccagagactaattattgcacttaaatatttgcctgagatactgcaacattctcaaacccatggttgcagtattgtgacacttagatctaggaagtttttgtagaactgctctgtacctgaatactttttgagagaattaagatgtatcaataatgctttgccatatgagttttttaaagtaacttgttcaatttactcacgtgttctaaacatctttccattacatgttctgtattttaatacattgcatattgacaactaggttctataatgtatgctttgaaatttacttttttatagtttacaggaattttattttttgtgcctatttctttttacacctatgtgaaccactatggaacaacttaaattttgtgccataaaaatatttttgtggtaaggtactatttttttagctctagggatatatcagcaaaaacacatcatgcaatttgagacacataattttgtgttgaatgagcacaacataatttgaagcattgcaaggagataaccagacagcagaattaaatggtcctgtctttttcatttttaatttattgtcatacatgggtttcatatttataacggcatcatgagctcattgcacttaatacctgcaatgtttgctactgtaccacaattgattttcaatactttattacgaaggatgaaactgtaatgttttattaacaatgcttctggaaatgaatgcattttaaagcaaataaatctttttgatagaccttttacaaaatccatttgcactaatgaatgctttcttatggcatataacttaatatttgttactgtgtacactgctgttttggaatgttcagaaataaagactctatttcagcaatatcaggtcatgc

SEQ ID NO: 274 - DNA, 1977 bp, Homo sapiens
gaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 275 - DNA, 3919 bp, Homo sapiens
agagcacatgcacactgtcagggctagcctgcctgcttacgcgcgctgcggattgttgctccgttgtacctgctggggaattcacctcgttactgcttgatatcttccaccccttacaaaatcagaaaagttgtgttttctaataccaaagaggaggtttggctttctgtgggtgattcccagacactgaagtgcaaagaagagaccctcctagaaaagtaaaatatgactaaaagcaatggagaagagcccaagatggggggcaggatggagagattccagcagggagtccgtaaacgcacacttttggccaagaagaaagtgcagaacattacaaaggaggatgttaaaagttacctgtttcggaatgcttttgtgctgctcacagtcaccgctgtcattgtgggtacaatccttggatttaccctccgaccatacagaatgagctaccgggaagtcaagtacttctcctttcctggggaacttctgatgaggatgttacagatgctggtcttaccacttatcatctccagtcttgtcacaggaatggcggcgctagatagtaaggcatcagggaagatgggaatgcgagctgtagtctattatatgactaccaccatcattgctgtggtgattggcataatcattgtcatcatcatccatcctgggaagggcacaaaggaaaacatgcacagagaaggcaaaattgtacgagtgacagctgcagatgccttcctggacttgatcaggaacatgttccctccaaatctggtagaagcctgctttaaacagtttaaaaccaactatgagaagagaagctttaaagtgcccatccaggccaacgaaacgcttgtgggtgctgtgataaacaatgtgtctgaggccatggagactcttacccgaatcacagaggagctggtcccagttccaggatctgtgaatggagtcaatgccctgggtctagttgtcttctccatgtgcttcggttttgtgattggaaacatgaaggaacaggggcaggccctgagagagttctttgattctcttaacgaagccatcatgagactggtagcagtaataatgtggtatgcccccgtgggtattctcttcctgattgctgggaagattgtggagatggaagacatgggtgtgattggggggcagcttgccatgtacaccgtgactgtcattgttggcttactcattcacgcagtcatcgtcttgccactcctctacttcttggtaacacggaaaaacccttgggtttttattggagggttgctgcaagcactcatcaccgctctggggacctcttcaagttctgccaccctacccatcaccttcaagtgcctggaagagaacaatggcgtggacaagcgcgtcaccagattcgtgctccccgtaggagccaccattaacatggatgggactgccctctatgaggctttggctgccattttcattgctcaagttaacaactttgaactgaacttcggacaaattattacaatcagcatcacagccacagctgccagtattggggcagctggaattcctcaggcgggcctggtcactatggtcattgtgctgacatctgtcggcctgcccactgacgacatcacgctcatcatcgcggtggactggttcctggatcgcctccggaccaccaccaacgtactgggagactccctgggagctgggattgtggagcacttgtcacgacatgaactgaagaacagagatgttgaaatgggtaactcagtgattgaagagaatgaaatgaagaaaccatatcaactgattgcacaggacaatgaaactgagaaacccatcgacagtgaaaccaagatgtagactaacataaagaaacactttcttgagcaccaggtgttaaaaaccattataaaatctttccatctcattacagctcattcgctccagcaagcccgtcatcttccctttcctcccttctgataagactggaaaatagtcctccaaaacacaagggaggattttgggtggccaaagtgtacaattttcatcccacaattgaaatttttaaatcatttcatgttagtcttaccgaataaggtaccaagatcacaaatagtgttgatcagatcttacaagtttatgtggcacacaatcctataaatgtgatttttttatataagttaaagagacaaatagtaggctaaaaacattttaaaatcaacttttgaaatttaaaaatctttcagaatacaattcagttttagtttcaaaatgttaacaacttgaattacaaccggttatcagttggacagtaagattttatccctttctcttctgactggtatacctatttcattagtagctaggtgcacatatacatctagcacagctgtgaggacagacagaaggcaaagtttccatgtggccttgagcaagtcccatctcacctctaggcctcagtgtcctcatctataaaatgagggacttccctagaagtcttcatggtctcttccagcccagacatcctgtgatgtcatgaaagcacctgccctctgtttcccctcagaacaccctgtaccatccatggagcacgaggccttcagaaaagacacttcaatgggagtgaacatttctaactaaggacaggatggctgtgtgtggtggtcaccaggtcctgtgagcaaagtgcaggttatgcaagtcgccaggcaggaggccattccaggagtgggattattcatcaaactctttgcccagttcatcccaatgggggaagtattcccttctttcctactctgggaagaatgtctcctgccactcctcaactgatgatagacttcgaaaacagatgagaagactagcagctagcaagggtgcttgtggtcacactgtggaacactaaagagctaggaaagagttgagcacaggcaacattacaaacaaaggatttgaaaacaccaagagtacaggtcttctttaaggaagaataaaaaagaagaggttcatttttctggctttttttttcacctgaaacactttttctcgagtccaaaatcattccccccgtgaagtctgcttaccaaaacataagacgacttatatatttgaaagaagtcaaatgaatgagctctctaatagaagtccatgagttgagtgggtatttcttatttgaaagtgtttttctttaatcaaaagtccttagaatgagggaaacaaaatatttatttgttttggaatcccacttatcaaatcattcaaaactttcagctggagtggggtttgcttttgttttgtttgtgtccataagagaaatggtagaagatgaatcagtatgaagacactgtcaatgaggttatgagaaaaaaacagcaggggcattagtttcaggcaaggcagctcccaggtttagagattaatttttaccccctaaggaatatccagtcaaagacgctgagtgggagctgtcaggcagtagcagctgtgtttgagtttctggctgaaaatggtgaagaatggacttaattatgctaacaaactgaaaaatctagacatagatcctctgatatacaattagagatatttttatatagaccccaagcattctgtgcataaaagttaacattaggctgtggtgcagtaaccatttaatgtcgaggctctatttcggaaatacactacaaatgttaaagtacgtggctgtcctcttaagacactagtagagcaaagacttaatcatatcaacttaattctgttacacaatatgtgttttttaatatactaaccatttcttatggaaaggtcctgtggggagcccatcctctcgccaagccatcacaggctctgcatacacatgcactcagtgtggactgggaagcattactttgtagatgtattttcaataaagaaaaaaatagttttacattaa

SEQ ID NO: 276 - DNA, 12275 bp, Homo sapiens
agactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaacagatgtgtggcaaaaggatgttgtttttctggtctagatccatctgtaccaacaagttcatcactttacagaacgaatctttttatccgtacaggaggttcaaaccatgtctgcctcttcctttgtaatgaatgacctttctatgagctgtgacaaaatttccgaacaattaactaaggatttgggaagagggggtggcaaacggggctttctgttttcctgcctcagcatgaaaacatctgatttatgctttatggaagccttacctccaatccccaactgttaagtcccatgaaaccacagttgctctgggctgatggaaacaaaaggaaacagtatgaagagttccttaatcatttttgaaacaaaaatgttaagggattttaaacatatgattatttttaattttatgccttttcagtactaaacacccatttcattgctgattcctgtctaagaagccattcacgtcagcatggcgatagaaagaatgaaaaaaccctgctgaatcatacagtaattttctttaaagcacatagtagttacataaatatatatatataaatatatttttgtttataactaacacaaggcaggatcttgtgactctaagagtgcgttttgtcatcaaggcaaaacagatgcaagatgcatcactgcattacttccatagagttgtaaaataatccttaatattagaatatttttctgtcacttagcaaaagtggttcagttcattgccgcgcccatcatgttcttgactatttgatccactttttcgtttatgtcaaccccttccctctctggctaaataaagtggatgcagaaagctccttaaatggagatatcgattgccttggaatcacaatcctgattttgaaaattcctcatgaatgaagaaaggaatggcatcccttgagaaggaaagtggttaatatacatactgagctcctaaagtttaaattcaggtactgagtgtacaatttcaccaacattctaacccatgaaacttttacactctgtgccaagaaactgttggcttttgtaaggtacagtgctcaacatttgcagattcaggtctcaagaagcagagatgtctcataagcagcattttcccaacagtttagcatctgtacacatctgccttggtcatcagtccactcacagagtaccatactttatcatcacaagtgtctgacgtgaacgaatgccattttctattccatatattttgctttacaattttaagtatttgatgaagatggtaactttttcctaacttagttaactattaaaaaaaattttgaaaagcaaggtgattgaaggattgtgatgacaatctctttgcagcagctatgtatggtttatgtgaagtatccccacttattcttgtggagcaggtttggtgagacagcaataaccaaatgacatgccaatattactggtgcaactggtattctacaaatgcataaggaacacatagacgacttccttttaggataaaatgatgcttctttcactaccttttgtggtagctgtggcttccaatagcaactgtttgacagttatataaatcttgcatgtgtattcttagtttgtgtcccttaagtactacttaattctcaagtagtaatgttattcttatacccttcagcgttctattttgattcaaaacaattgattcaaaacaattttgaatcaattttctattttgattcaaaacaattgataattctgtaaaaaaacataaacactgaattcttcagtgaaccaaagcaacaaataatagagaaaacttcttgaaactggagtgtgggaaaacttcttaacagaactaagagttaaaggtagtgagaagtgtgtggtgtgtgaattctttagtggtaaggggaaatgtgggctaaatccttttctttcatgaaactctcattctattttatatttctggtttgttcttgttcccatgtgagaaaacatacagtttctgaaaattcaaaatggtcatcaatgctttggactttacataattatgtattagagaaggtgcaactgtacattacttaatatactatgaacataatagaataacaaaaaaagataacaaagagatgcaaacttctggataaatcagataaatggtgctacagaggaatttagttatttcagcttaattatttgtaaaaataataatcagtgactaggtaaagatactgaaactcaagaaaaatatcttgacccatttatgtctagtgttccattattggaacgctaagcttatgggagttatttagagcctactgctcaaggtcatcaccaaggtctggttgcaaaaattcaaaaaattgcaacctcaggcataaatggcttaagcccaagagatggcactgaccataaatggtggcttgtgtgtgaagggtttggacttcaagatatactaacacctagaaaactaaaagtgcaattgacccccaattactattttagtttgaggtatcaagggcatttgccaatctcttatatgtagcttctagagttgtgctgtccaatattatatccactagccaacgtggcttttgaaattaaaattaattaaaattaaattaaaaatgtaattcttcagtcacaccagccacatttcaaaggctcaatagccacgcctggcttgtggctaccatattggataacaagaaacacttccgtggttgaagaaaattttaatggacaatgctgtgtttcatttgaattcgttgtccttgaagaaaagggaagaagaggaaagaaacaagatttggtagctcttgggcatatccaagcatttttgattttagagaggccctatggagtaatgaaaaaaatacaagctgacacagctttaaatccccactgtgttatcttgggaaaatcacttcaacctccttgagtctcaatttgcaattttggaaaagaaaaacaatttttgtcctgtctttcttgcaagattattatgcaacctgattaaatgtacagatgtgcagactcttaaaaaccttatgttaatgtaacccatataaagtacgacttttggtcgagtaccagcacaaatttgcattcaaaggaagaatagttcatcagtgcaaaaagcgttcaaaggtaatcagttcatcacgtatcttgagaaaaagagaatgcattcaaaacacaaagcaaaattgcttcagtttcttttctgcccatctgaatatttcctttagtatttgtcccacatgacatccatcccatgtatttatccactctttcacaacattgcctatgaacatccttcaactggctcagttctttattgcatagagccacttagcttctctagtttcttatgatttcctattttacacttaacagcaaaaggaggcttccatttagaaggcactatctcaaacataaataatttcatatttattttatcactgtaacactaaggagctatggcattaaaatataaaactatttggaacttaatgtaaacctttgcacatgcagactatataaagggaataaaattattttaaattatgctaatatccagatacatattctaaggttagtatcatttatcagtttttcgcaacagattcttatgttacatcttcatgagggagtataaatttgatcacgtccctagtgtctattgcccacttgagaaaggttttgccaggatccacagatcgcttcaagatgctttcgtttatgataggaaattaatatttaaataagactaattgaaaactagattatctggttctaatttcttcctcctgtgaaatgttcttttggtttgtatttctttaggtattttccaagttactgctgcttttacttcacgacctccaaccccacttttgttatcagcgtcatatgccagagtcatggcagatccagcctggacaacatagtgagacccatctctatcaaatatacatatatatatatatatatacacacacacacacacacacacaaatatacatatatatcaaatatatatgtatatttgatagagatgatagcaattatgtgtgtgtgtgtgtgtgtgtgtgtgtgtgtgttagccaagtgtggtttctcatgcctgtagtcccagctactttggaggctgaagtgtaagagttgcttgagcccatgagttagaggctgctgtgagctatgatcatgccactgcactccagcctgggcaacagagcaaaaccccatctctaaataaaaaaaaagaatcgtgagacatcatgtaatccaacctcttaatgttacagataagtaaactgaggcccaaagagatatagtaatagtcccagtgtcagtaaactgggtcttgaacttaaatgtttgtttcagttctcattgccttcatctcttaattgtcggcacttaaggccaaccaagcagcttagacagcgcagtccactcaacggtaactttatttgctatattgacaatctgctctgttctgtaatatagaacattggatcaatctttatctttttgctgacttaaggaggctgctattgttgcaatatccagagatttcaagttctagccattgcggggtctttgtggtgttttcaatttctcctctctccacccctgcccccatctgtggccatctaagttagcaatacaatttattttggccatttaaaatttttctgcctttgttttatttcttcccaaatatatttgaaaatgaatgatctatatagctgattttctgaccacatatataattgcaatttttatttgctcttcaaactattacaacatttttgtccttataaggttttttgggcagataatgcgaggtctgtggtgttaccttttatatactcctattaccttatgtttgtgaagcattttacattttacagagcactttgattcatctccctatttgttcatttatttaactgttcagttcactgaaatatttattgaacacctactggaaccaagtgactgtgctagtaacttgtgatatacagtagtgagagtccaggcatgtaaccgatcattataatacaataacatccctaaaccagactttacaagtagataggatcaacaatactctatcaattttcaactccaattttctattctacttaaaatgggaactagaaactgtttgcctgaagaatgtgtctgaaacataatatatcactgcatgtctgtgctgtagacctgttaattttatctgtgagaaaaaaagttactcaaaattctccctgacctaagaatactttctagttcactgcagtcttactgaccagatgcaacagttgaagtttgatttctcgacccaatatttctattgggttttgaattattaatatcactgttttgaggtattcagaaacaccagtgtatcaaaaaagcatttgcactttaggtgtgtgtggtggttatgtcatttattagaccatcccagacataagacaatcagggaaatcagaaaactccagcctcaaatgtgtctataatttcctgttctaccattgtcatatcataacatggtattacttcttaaggttttgattaagttgatctagcctcaacttaaattgtaatacatctgcctaattattgtctggaataacttttcaaccatccaatgcccactgctctcacaatgattattgtagagaagtaaaatggtaattattcaagtaaagtcacataatttctggagtcagtttttcataacaagtttatggaatacatcatcattggcttcttcataatatatttattatgagtgaccaaattttgcctggaggagcaaaatgctcaaaacttgttattataggttaatttccagctcactgttgacactgaaagattctgtgttactttaaacccaggataaaaggctggaaaaaaaattaaatgtaagtcataaactagtactcagcttttcctagtttctaaggcttattaacatttgcaaattactcaataaatgtctttcataatggaataacataaaagcttttgatttggcagatagtgatattttatttattttcattctggttgaaaaaaatctcagtggcttctcttcattccacgagaattttgatttttaacagcagtctctctttttctcagcattgcaaatatatatgtatatatacattcatgaccaaagtatcgcttactgaccatgcagctgtaaaccttctgtgcctatcaaacaaatacatagcatgaaactaattttagaagtttcatgggggaattttaggggaaagtataaacctaagagtgagtgaatggagatgattcatggaaaaaaaaataaaaatctaaatgtgctattaggcagagttattaacttcttttagttgttgtttgagatggggttttgctcttgttacccaggctggagtgcaatggcgtgatctcgtctcactgcaacctccgcctcccaggttcaagcgattctcctgcctcagccgcccaagtagctgggattacaggcatatgccactacagccggctaattttgtatttttagtagagacggggtttctccatgctggtcaggctggtccccagctcccgacctcaggtgatccgcccacctccgcctcccaaagtgctggaattacaggcctgagccaccgtgcctggccgagttattaacttcttaagagcaatgtgctaataaatactcattgatgaccagctcaaatttaggtcattcagacatccagacactggggcacatattctgcaagcaatgctgagacccctgacatagagaaagcaaaggatatgcctatgattagtctaaaatgcagccatcaccccccatacctcttctatggcattcatcctaacatcatggaggcctttgtcctagagaattatgtgacttgccctagagaattagtgaatgaccaaaaagagactttccatttatcttcctttgacttaaaaggcatgaaaataaggcaaaaaaatcaataaaataattttcctgaggaaaggttaagagatggcactttcctttccgggcccagagctggatttctctgagatttgaccatctcaggactcagacagactccagtgctattttctggacatttgtggtgaagcctcagccaccatgttcaaggtggtttgaatgaaaacatactcagattgtcacatttatagcagggaaataaaaactcaaattaggcatcctgcagcaggctactctgaaaataacattaggcaacatcagagcttcacttgcaaagaaatgttaaaatcattttagggaaatcagtgaagtctctttagaaacagacatcttgtgtatggcgtaacccagtcttggggccctcacggagaagagggggaagtcttttcattgattggtcaaaacaaatctctcatttgcctgatttgaagcatttcaacagtgcctggagagtacattattttcaggggaaaaaaaggagagagtcttttttatatgccagctgggatcatgggaacttcgaatgccaggaatttactactgtttctggtaattctgtgtgtagtcatttgaaatgttgaagtgtgaaaagagaagaaattgggcacttcttgcggcgggggagggggggggggcggtggctttccagattttatgccagttgcaccagcatgcagaatatttgtaatgcatttcaaagtggatataatggcaccctttgtcagaatcacaaagctcactgcggcactgctacaagaggacactgaggaaaatctggccctatgaacctagtcaaccccaagcaaaaagaatgactatgtgtgtgagtgcagcacatggccagttcgtttctcactgttttggaaagccctgtgtgccaaaccaaggacgtgtctttcagggaaaggttaattttccgaagtttattaaaatagaacttggaaaaccaagcattttgaatttattccagtcctctgggcatcattcctatttcttctgccatgtcaaggagaaattccaagcctgcattctgtcatgctaaaataaccagcccatacttctcggtgaccttctgttgaacgtacctgagcctgcaaatgtaaaaatgattgtatctgaatctgcactaatggtgtctgagagcaaaaagagtgtgacctctattggaaacctttgttcaaattcaataattcagagatgctacatacttctgcaagcttcctgattatgttcactgtaatattaatgacctaagtttgaatgtatttccttacagtccattaatttgacatccatcttttacctggggattattacaattgcaataagtcattaatgttttcttcacacagcttcttaaaccaagtttctctgcagctctttcggttctgcttacagtgtgtgggaaatctgatttttttcccctagtaatagtttgataagaaatttagtgtattgactgcctcagtgacacaatttatctttaaaggtgtggaagctggtggggaccaaatgttacctgtgtttttgctgttgattgctattttcagaagcaaaccatgtttttcacttacagtaggagtcaacaaatttgggattttagaagggggaggagggagctatttgtgtaagactgctgtcatatttgactacatattaaaaacagtaaatgagcattttgttttaatttcttaaataccttgtctttcaacatacgttttgtttcctttcttccattagtgttcaaaaggttctacccattgtggaagaaattctgtgtgcagaattcagaggcacaaggctgatggcaagatagaaagttattttgcttctaaacccaccccgatgtggaaactgatactagctagagggagctgtagaaaacaaagatttcaggattgcacagtgtgtgggcaatgggatggagactttttcccctattcccagccacagtgcccaagcgttcaagtctcctggatcagacagatgggattttagctgctgctttaaatcctagtgctggaataagtcaaggtacttcagttcagctcttgcctctgtcactaatcttgctttatgaactcctttgattttctgaataagttccagaaggttctctattattctgtccttcttccaaactggaaatggctgtatctaattctcaggatattttggatgtgtgcctcaggtaatttatgtggaatgtgtaaagcaagatgtctccaattctgaatattccttccccttttcccaatcctccactcttggactacctttataacaacaccgagtacgcacagacctgaacccatgcccaagaagcacacacaatgactggagctgtcgggaattcctgtcagtggcattccctgagcactggctctgtacaactcaattataattttttaagaatcatacctctgtatagatcttttggactgtactgattaaactttgatattgtggagtaaattcagaagtgcaattttaaa

SEQ ID NO: 277 - DNA, 1888 bp, Homo sapiens
gacttggattgacatagagagctgcaggagggtgacatgatctcaataaaaggaatgctctggctgctgggtagagaagaaagcgagggtgagggattaatggtggagccagagggagcccagtgagtgccgggagcccagggtggcagagctgtggtgcagggttgcagggtcctggagctaggcatggaggctgctttcgggcaagtggccgggtcagcctgtcctcggagaggcggtgaaggcagagactggaaggcagagagccttgccgacctgtggccgaagagctctccgggagacagccaccggtggtgcaaaggccctggggccggcccagccgggccgcagctccgggaggcggcgcgagcgagcagtgggctgggcggtggcggccggcacccgagccggatcccggcgattgccttacaagacatgctgctgctgaagaaacacacggaggacatcagcagcgtctacgagatccgcgagaggctcggctcgggtgccttctccgaggtggtgctggcccaggagcggggctccgcacacctcgtggccctcaagtgcatccccaagaaggccctccggggcaaggaggccctggtggagaacgagatcgcagtgctccgtaggatcagtcaccccaacatcgtcgctctggaggatgtccacgagagcccttcccacctctacctggccatggaactggtgacgggtggcgagctgtttgaccgcatcatggagcgcggctcctacacagagaaggatgccagccatctggtgggtcaggtccttggcgccgtctcctacctgcacagcctggggatcgtgcaccgggacctcaagcccgaaaacctcctgtatgccacgccctttgaggactcgaagatcatggtctctgactttggactctccaaaatccaggctgggaacatgctaggcaccgcctgtgggacccctggatatgtggccccagagctcttggagcagaaaccctacgggaaggccgtagatgtgtgggccctgggcgtcatctcctacatcctgctgtgtgggtacccccccttctacgacgagagcgaccctgagctcttcagccagatcctgagggccagctatgagtttgactctcctttctgggatgacatctcagaatcagccaaagacttcatccggcaccttctggagcgagacccccagaagaggttcacctgccaacaggccttgcggcacctttggatctctggggacacagccttcgacagggacatcttaggctctgtcagtgagcagatccggaagaactttgctcggacacactggaagcgagccttcaatgccacctcgttcctgcgccacatccggaagctggggcagatcccagagggcgagggggcctctgagcagggcatggcccgccacagccactcaggcctccgtgctggccagccccccaagtggtgatgcccaggcagatgccgaggccaagtggactgacccccagatttccttcccttggatgctttcggtcccctcccccaacccctccccctggggctggcctctgctggattttgagatttgagggtgtggcgcatggcgctggggttggaatggggcacccccaagtctgtccccaggctctgccctgcctgggggcagtggctcccctcccctgttgcctctcccgcccctgccccccccgccccgccaaaagccgagggggtgctggcaggcgggcctcaggggctgtctttcctgcacggctgttgtgtgcttcgctgagtgtgggtggtcctgcttgtgtcatggtcatggccttccagccccctccagttttccccaaaccaataaagaaagatacagcaaaaaaaaaaaaaaaaaa

SEQ ID NO: 278 - DNA, 10547 bp, Homo sapiens
gcttttcgcccttccttggccgccagaggctccctctctctccctctcccgggattttgctgccgggctccctctctctgcggccctagagttaatcccatcagccgagatgaacctctagtcttgctttgaaaaaatcattctgtgtaactcttgactgtgactaagttcctaatacacctgttgggacgatcactgacaccgtataccatttgagaggtacttttcttgacccaatactggtgattagagaagagaggtatcttggtttttggtttttttctttgatcattatgaacattggcttttcacccctgaagtgaaaatgttgaaaactgagtcttcaggtgaacgaaccactctcagaagtgcctctcctcacaggaatgcatatcgaactgagtttcaggcactgaaaagtacctttgacaaacccaagtcagatggggaacaaaaaacaaaagaaggtgagggctcccagcagagcagggggaggaaatatggctccaatgtcaacagaattaaaaacctatttatgcagatgggtatggaacccaacgagaatgctgcagtcattgccaaaacaagggggaaaggtggacattcatctcctcagagaagaatgaagcccaaagaatttctggaaaaaacagatggctcagttgttaagttggagtcttctgtttctgaacgaattagtagatttgacactatgtacgatggcccttcatattccaagttcactgagactcgaaagatgtttgagagaagtgtgcatgaatcaggacagaacaaccgctattccccaaagaaagagaaagctggagggagtgaacctcaggatgaatggggaggttccaagtccaacagaggcagtactgattccttggacagccttagctcccgaactgaggctgtctccccaactgtgagtcaactgagtgcagtatttgagaacactgattctcccagtgccatcatttctgagaaggctgaaaacaatgaatactcagtgactgggcattatcccttgaatttaccatctgttactgttacaaatcttgacacatttggtcacctgaaggattctaattcctggcctccttcaaacaagcgaggtgttgatacagaggatgctcacaagagtaatgcaactccagtaccagaagtggcttctaaaagtacctctctagcttcgatacctggtgaagagatccagcagagcaaggaacccgaggactccacatctaatcaacagactcccgacagcattgacaaagatggtcctgaagaaccttgtgctgaaagtaaggcaatgccaaagtccgaaatcccttcaccacaaagccaactgttagaagatgctgaagctaatttggttggaagggaggcagcaaagcaacagaggaaagaacttgcaggtggtgatttcacctctcctgatgcttctgcatccagttgtggaaaagaagtacctgaagattcaaataattttgatggttcccatgtgtacatgcacagtgactataatgtgtatagggtgagatccaggtataattcagactggggagagacaggcactgagcaggatgaggaggaagatagtgatgagaacagttactatcagcctgatatggagtactcggaaattgttggattgccagaagaagaagaaatcccagcaaataggaaaattaagtttagtagtgctcctattaaggttttcaacacatactccaatgaagactatgacaggagaaatgacgaagttgaccctgtggctgcttcagctgagtatgaacttgaaaaacgtgtagaaaagctggaacttttcccagtggagctagagaaagatgaggatggtcttggtataagtattattggaatgggtgttggagcagatgctggacttgaaaagctgggaatattcgtcaagacagtaacagaaggtggtgctgctcaacgggatggcagaatacaagtcaatgaccagattgtggaagtggatggaatcagcttggtgggtgtgacacagaattttgcagcaacagttctcagaaacaccaagggcaacgtcagatttgttattgggcgggaaaaaccaggacaagtgagcgaggttgcccagttgataagccagacactggaacaggagaggcgccagagagagctgctggaacagcactatgcccagtatgatgccgacgatgacgagaacactgtggctgaattgcaaggaatgtctggcaactgcaataacaataacaactattttcttaagacaggagaatatgccacagatgaagaagaagatgaggtaggacctgtccttcctggcagcgacatggccattgaagtctttgagctgcctgagaatgaggacatgttttccccatcagaactggacacaagcaagctcagtcacaagttcaaagagttgcaaatcaaacatgcagttacagaagcagagattcaaaaattgaagaccaagctgcaggcagcagaaaatgagaaagtgaggtgggaactagaaaaaacccaactccaacaaaacatagaagagaataaggaaagaatgttgaagttggaaagctactggattgaggcccaaacattatgccacacagtgaatgagcatctcaaagagactcaaagccagtatcaggccttggaaaagaaatacaacaaggcaaagaagttgatcaaggattttcaacaaaaagagcttgatttcatcaaaagacaggaagcagaaagaaagaaaatagaagatttggaaaaagctcatcttgtggaagtgcaaggcctccaagtgcggattagagatttggaagctgaggtattcaggctactgaagcaaaatgggactcaagttaacaataataacaacatctttgagagaagaacatctcttggtgaagtctctaaaggggataccatggagaacttggatggcaagcagacatcttgccaagatggcctaagtcaagacttgaatgaagcagtcccagagacagagcgcctggattcaaaagcactgaaaactcgagcccagctctctgtgaagaacagacgccagagaccctctaggacaagactgtatgatagtgttagttccacagatggggaggacagtctagagagaaagccatcaaacagtttctataaccacatgcatattaccaaattacttccacctaagggtttgagaacgtcttctccagaatcagattctggtgttccacccctcaccccggtggatagcaatgtgcccttctcgtctgaccacatagctgaatttcaagaagaaccactggacccagaaatggggcctctctcctctatgtggggagacacttcactgttttctacttcaaagtctgatcatgatgtggaagaatctccttgccatcaccaaaccaccaacaagaaaatattacgagaaaaagatgatgccaaagatcccaaatcactaagggcatccagttcattggcggtgcaaggaggaaaaattaagcggaagtttgtggatctgggggcgcctttgcgaaggaattccagcaagggaaagaagtggaaagaaaaagaaaaagaagccagtaggttttctgcaggtagcaggatcttcagaggcagactggaaaactggacacccaagccatgttcaacagctcagacctccactcgttccccttgcatgcctttctcatggtttaatgacagccggaaaggatcctattccttcaggaacctgcctgcgcctacaagttcccttcagccttctcctgagactctaatttcagataaaaaggggtccaaggtagaaaacacatggattacaaaagcaaacaagagaaacccaaatccctcctcttcttcaatctttggaaggcattctcaacttatgtctgtagtctggatccaagaaaccaataattttaccttcaatgatgacttcagtcccagcagtaccagttcagcagacctcagcggcttaggagcagaacctaaaacaccagggctctctcagtccttagcactgtcatcagatgagatccttgatgatggacagtctcccaaacacagtcagtgtcagaatcgggccgttcaggaatggagtgtgcagcaggtttctcactggttaatgagcctaaatctggagcagtatgtatctgaattcagtgcccaaaacatcactggagaacagctcctgcagttggatggaaataaacttaaggctcttggaatgacagcatcccaggaccgagcagtggtcaaaaagaaactcaaggaaatgaagatgtctctagagaaggctcggaaggcccaagagaaaatggaaaaacaaagagaaaagctaaggagaaaggagcaagagcaaatgcagaggaagtccaaaaagacagaaaagatgacgtcaactacagccgagggtgctggtgagcagtaacacataccctcttacagatgatggagatgctccaagagaagtccccacctcttcctgccctgctctcctccagaggatgaaaaagaaactaaatgataagggtaatgcggctctaggccggctgaggaactgtgtgttgaataactgcattttctgcaatagaatgcactcttaattttaactactaaaataatcccaagccacctttggttcattaacaaaccagagatttcatttaagtagctgtgttttgctcttctctaacttaccaacatcttgtgttgtgttgggtgtgttttgtcacttggagaactagtgtgaccccacccaagagcatgacacaccctggtgttgttaatggagcgccgtgaattttcagtgtgggatcctgaaatggcaattgcacatgtctgcatggcagagagcaccctgccatgagatctgagaccagtacttaacttctaggactgcaacacctactccaatgtgtgggaaagatttgctcttaattctcagtctggacagtgagaccaccccgctgtggaaacatgggtgctctgctctgtagttacctactaagggaaaaggcaagcaagtcattctgcttgctaggcatcaaaaagaaagaaaataaattatagctatttgttaaccactgaaaaaagcaaaagccttaagaatgtggatgtgggtattaccttggggttctgagggtaatatttatcctctagatacggctgaacaagaaagaaaaaaatcagacattaatgcagccatgggatattgggatctgttgaccttgctactgctgtgtgttcagcatttcagcaacactggcaaacacaacacagttcctcttccccctacctaacccaagaaattgaacaggaaattgatttttaaggaaaccaccattttcaggtttcctctcctggggaacattctggctggtcttcagcctgcctatgtcacaatcaggaactcatcacatattttctactcaagatttcccaggtgggctcagttagtattttaacaaatgtacttttaagaaaaatagaaataccagttagaggaaactgtcagttaacattttagagagattttgaatggtttttccgaaccattcctttccatacttcaaagattctcaattttacagaaaaagtttgtttaaggcagtgcataggtatactttagtagtggaggaacttatactaattttaagccagcattaaggatttccatgtttcaccaaactaagtcaagtgcaggagactggggcagaagaaggagaaaataaactcgttttgagaaatttcatgtgatgagggttttttgttttttatgctcatgtatctggttctctttgctgcgttgactctaaaaatgaggttatccactttccaaaggacaagtttcagaataagacttgaggccacatgaattcttggacagtattttacttcttttactttatgggaatctctgctctgttcccagcatctcgtatcttccactagaagtattccatatttagagcctcggcaaggcttttgagtgtaacagattaagggaactcccttgtagccccatcttgtattttaataacagtgtgatttttttttatctgaaaatctgaattcagaaattatctaaactggacatttttaattctgttttacccccaaggcctgttttcttttcattgccagagtattgtcggttatgcgtcagctcttttgtcattaggtacagacccttcattcaatcctcagaaacgttgacatgaagtaacattgtgttttacagttatcaaagtcaccattatgtttttctgtctgtcttcattaggggtatgataatgaaactgccgtattggatactctattaatgtcttgagatgtctggtgctttgttattttttcacatcatgagaaataagaagccactattaatgagtgatacaatttggcaaaacttttcaaatactaaaacactaaattagtaaaaatctggtaatattagtgcttgctattgtaaatttttgccatttttgcttatctttgggaaaaaagtgacctggatcacactggaagtttcactgtattcaagagtagaaatagaaggatgattatcttaagttatgtttacactttggtaatatttgaaaatggatgtatatactggaaatgtctgtaagtgtcttgtttttgcacctaatttatgatctattatattgcattttcttaaatatcttagaagtatttttctttataactttgtatattgaatgtttagataaatgtccaactgacaatgttataaatcaaattcttattcctaaaatcatttagtattataagtattttgattttttaagttaaattatagtaattttaggccgaagtgagttattttaacattaccacttaaaacggatgaaattgtaaaagtcatttggtttgattgccccacaaagcataagatgtaaactgattaagggtatgaaagcaaagtgaaagacctcagatcttgtgcacattttgttttcctattatttcttttattgactgtagtgcatgatacctaatcaaggctccaatgtcttgcacaattcctactttaatgctagtggttttcagtgtccttacaatttaacacagaattgttatttcatcaaccttaaaaactgcagtttttattatcagaaaatgaacaaaaagggaatatctggttgctatgaactgattccctaaaggagagctcagtatgattctaacaatagccaaaagtgttttggggtataggttatgctttgttgggagggaatgtgtggtgaggaggccaagctgcagacagaaagcattgtatgagctgtatctgggtcagggtttcccattaaaggatgttagttttataacagattactttgtttaagaccatctcccttcaagtaactcacagtttatgtaatactaatctcattctttttttacctgaatcaggaattttctgcagaatgttaagttagggaagaaacctcatttcatccattctaacactcctgatgaagtccccctttagtttcatgacaataaagctgttctgtggctatcatcctttagctgggattgacaattgatttcacaccctcaacatcacaagctttttttaacccacagcagttcatgattgcagtatgataggtactaaagccaaactcagctttcaactggcacaaaatgggactgtcaccttttgctccattgttgttggaaacaaagtggcaagagggaaaatgaggaaccagatttacctttgccactatctgtgaccctgtaatcatcactagcctgaaatcttaaaatatcccagtcccaagctacaaaaatggtcacaggtggtttgatctagcacctcggccgttagagtttgtgctgaagacaaatttgtctgggttcattgtgcaccagaattagcatgtgcttgaaaattgcattttataaaagggaaatgaaaatttgcatttatatagatactctgattcatgtttaagtgttaaaggttatgcagactaaacttcaagaggagatccagtgtttaacaatagtgttctagaggattctaaaggaagctgccccagcagccctgagagaaccatctatactttggatatgttgtagccccatcattacactgagatatttccatttgagtaactaaaggtactcctgacagagctggagatgaggggcattttggtgggcagtggtcactagggttcacgtcacctacttaatgcaaagaccttagtggtctcagaatgaaaaggtaaaatggaagagaaaagcacagtcctttcctgtcttttcaaatttactttttattaaggatgtacctgtgcactattctaaagctaagcatttaaggataaagtccagaaataaaatgtccatattttcttttcttttctttttttttttttttttctgtcatctgtcacccagactggactgcagtggtgccatcatgtcttactgcagcctcaaactcctgggctcaagtggtcctcctgcttcagcttcccaagtagctgggactacaggcatgtgccaccacccccagccaaaacatccatattttctattagaatggtttacattatgatgggggatggggagctgggggagggctgtacattcccaaaagaaagtagtgttataggaaatccaaatgcgcttcagtgattcactcctgaaaagcagcctgggtatgttggcagattttgtttgcatttgtcttgcgtatttaaagtctcaggaaatctagtcttggtccaaaacactggagaaaaaaataacaccagacaaaacacatttgagtaacttgaagtagcagcatagaataggcccaactaagaagttggaggggcaaagagaaagccgacagaatcagcttctcctggaaagtgaaagcatcaagttctatttatggtagacagagggtccttatttgcttgtccgtggtgtctatgtgggcctattgagggaatggtagttacttgaaggttcacatatgtaagcgtgtggacccagcacagtctgtgacctgattccagatcctcaagagtggagaaggaaagaaatatgatgatttcctatgcttgaccctaacccaaccccaaaactgctagggattcaacagtgagtaagatgtatgcaataagagaacagataacttctcaacaatgtgcatgccgtttgtgtagatgttcagaactacatatgtgtgaatatcactcccaccttacacacgcacacacactgcaatcacatggcattaaaaaatatattgtgtatggaacttggcgaggtcagtcaggacctggagctgtaatcatagccttattgccacttcttgcgttgtgtatacattgaatggctcatagattttaagagatttttttattgtaagtatttctactaaatgcacttatccttctatatgtttatatattttggtaaaattgatttatcagatacttggtattttagtaagaaaatttcctcaaatatttggctaatgctttgatgtcaagattgcatattgctgagttggagctcagaagaaatgtatgcagctaaaaattgcactgtgtgttcttgtgaatttgctcacaattctaaaatgacataattggtggctgtgatgcttacagtcactgcctactggctctcttatgatgaatgttgccatcatatgatcatttatttactttttgtgcaagcaatggcattttggttgttgccaaaaacaacacaagtggttgggagtgtatgttgttggaaggtgtacacttctgtttctttcagctgtattatttatacacccaggttttctgttaaggatgtaatcattcattcaagaaagaacaattggcaagaaataattaaattaccttaaaaagaattaagaggcactccagccagataacacctcccaacaacatgaaatttagttagtgcttagtgaaattccttaaatatatatgtatatgttttcttcaacattatttaatataactactgcttttatattttttaatggtgttgcaaccacttgtacacctgctacaccttactgacaaaactgggcagctgaaaataaaagagaataaattctattccactgtaagaagttgatttcttttcagctttctttgtatatcagtaaagaacacgaattgtttgaaaataattttaagtctgataagtatggatagcatgttacctaagcttttaatttgtacattttgatgtctgatcatttgcatggaagagacaatagtgccacgtctgaattgttctcttgtgcttggttaatatgtacttctctagattgttcaaaaagtttcaaatgacattccttactctttggttttcagaggcattcaagcaaaatatcacagtggtcttttgttttctgaccaatctaacaatacctgtgattaaatttaatttgttagtgtaaataaatttcttgccaatgagtattattgttgttagacaacgaatgcaataaaaagaaatactga

SEQ ID NO: 279 - DNA, 1968 bp, Homo sapiens
agtctgggtctggagcctgagccctgcggaacctcggcgctcggccccaccccgcccgtacctgcacttatttattgttgttatttcttaccgcggagccccgcagtcgggtcctcccgcccgctcccgcgcagcgctagcattctccagtccctcagtcccttcccgcgcggtgcgccgcagccgaggcgatgcgcctcattcagaacatgtgcaccatcgccgagtaccccgcgccgggcaacgccgcggcctccgactgctgtgtgggcgccgccggccgccgcctggtcaagatcgccgtggtgggcgccagcggcgtgggcaagaccgcactggtggtccggttcctcaccaaacgattcatcggtgactatgaaagaaatgcaggtaatctctatactagacaagttcagatagaaggtgaaaccctggctcttcaggttcaagacactccaggtattcaggtccatgagaacagcctgagctgcagtgaacagctgaataggtgcattcgctgggcagatgctgtggtgatcgttttctccatcactgactacaagagctatgaactcatcagccagctccaccagcacgtgcagcagctacacctgggcacccggctgcctgtggtggtcgtggccaacaaagctgacctgttgcacatcaaacaggttgaccctcagcttggactgcagctagccagcatgctaggctgctcattctatgaagtgtctgtcagtgaaaattataatgatgtctacagcgccttccacgtcctctgtaaagaggtcagtcacaaacagcagcctagcagtacacccgagaagcgaagaacctccctcattcccaggcccaagtcacccaacatgcaggacctgaagaggaggtttaagcaagccctctctgccaaagtgaggactgtcacctccgtctgaagcaggaggagcactcaagggggtttggtcttcccaggaagagggcctgaggttctcctagtgcaggaacgttgaatattggcaatgattcctggttccagaaagggctggagcagaagggccaagagggcctgtggaactgctacagaaaaggaagtgttgttctgagcagggggacaggattgatgaggcttgaaagagcccactgagccactctctgaatatgtgaaatgtactctgtgtcttttcctttagagtggggagggggcataatcgtttcggtttctgcattcaactaccttgtaaatggtggtccgttgcagtttcaccaaatgtattgatgtgatttacagtgggaatgaaagaacagattaagcattgataggctttcttttttcccccttttttcttttttctcttttcttctttcttttcctctttttccccaagaggaagaattgcttttctcttaccagtatgatttgtaactctggaacactattcttacagaatgcctttctaacctgaaggatacccagatttctttctttatgtacaagatggaaaatcccctacccctcaaaaacaggttgagtttatgggccagaatattttgtataccagacattggtaagctctcatggtttacaggaaggctctggttccccctcacaggatgagcatgctcagttgggcgtgtgtggaggagctgtgaacttcacgctcttcaaccccagactttgactgtatagttttttgtttttttaactgttccatcaggaaaaaaatgtgtcagttgattttggtgtgacttgtgtaaatggttcatggcaatgacgttgggttgcttcctaggcctggctgagttgtgcctaagggtggctgaaatactaaaacacttatcttacagcaagtgaacaggggctacctgccacatcccctccacagatgcactttaaaaagccactcatgctttggcttaaactgtaattaatttattttatgtacaataaatcgcatttgaaaaaga

SEQ ID NO: 280 - DNA, 9682 bp, Homo sapiens
tgctgctctcggtttagtccaagatcagcgatatcacgcgtcccccggagcatcgcgtgcaggagccatggcgcgggagctataccacgaagagttcgcccgggcgggcaagcaggcggggctgcaggtctggaggattgagaagctggagctggtgcccgtgccccagagcgctcacggcgacttctacgtcggggatgcctacctggtgctgcacacggccaagacgagccgaggcttcacctaccacctgcacttctggctcggaaaggagtgttcccaggatgaaagcacagctgctgccatcttcactgttcagatggatgactatttgggtggcaagccagtgcagaatagagaacttcaaggatatgagtctaatgactttgttagctatttcaaaggcggtctgaaatacaaggctggaggcgtggcatctggattaaatcatgttcttacgaacgacctgacagccaagaggctcctacatgtgaagggtcgtagagtggtgagagccacagaagttccccttagctgggacagtttcaacaagggtgactgcttcatcattgaccttggcaccgaaatttatcagtggtgtggttcctcgtgcaacaaatatgaacgtctgaaggcaaaccaggtagctactggcattcggtacaatgaaaggaaaggaaggtctgaactaattgtcgtggaagaaggaagtgaaccctcagaacttataaaggtcttaggggaaaagccagagcttccagatggaggtgatgatgatgacattatagcagacataagtaacaggaaaatggctaaactatacatggtttcagatgcaagtggctccatgagagtgactgtggtggcagaagaaaaccccttctcaatggcaatgctgctgtctgaagaatgctttattttggaccacggggctgccaaacaaattttcgtatggaaaggtaaagatgctaatccccaagagaggaaggctgcaatgaagacagctgaagaatttctacagcaaatgaattattccaagaatacccaaattcaagttcttccagaaggaggtgaaacaccaatcttcaaacagttttttaaggactggagagataaagatcagagtgatggcttcgggaaagtttatgtcacagagaaagtggctcaaataaaacaaattccctttgatgcctcaaaattacacagttctccgcagatggcagcccagcacaatatggtggatgatggttctggcaaagtggagatttggcgtgtagaaaacaatggtaggatccaagttgaccaaaactcatatggtgaattctatggtggtgactgctacatcatactctacacctatcccagaggacagattatctacacgtggcaaggagcaaatgccacacgagatgagctgacaacatctgcgttcctgactgttcagttggatcggtcccttggaggacaggctgtgcagatccgagtctcccaaggcaaagagcctgttcacctactgagtttgttcaaagacaaaccgctcattatttacaagaatggaacatcaaagaaaggaggtcaggcacctgctccccctacacgcctctttcaagtccggagaaacctggcatctatcaccagaattgtggaggttgatgttgatgcaaattcactgaattctaacgatgtttttgtcctgaaactgccacaaaatagtggctacatctgggtaggaaaaggtgctagccaggaggaggagaaaggagcagagtatgtagcaagtgtcctaaagtgcaaaaccttaaggatccaagaaggcgaggagccagaggagttctggaattcccttggagggaaaaaagactaccagacctcaccactactggaaacccaggctgaagaccatccacctcggctttacggctgctctaacaaaactggaagatttgttattgaagagattccaggagagttcacccaggatgatttagctgaagatgatgtcatgttactagatgcttgggaacagatatttatttggattggcaaagatgctaatgaagttgagaaaaaagaatctctgaagtctgccaaaatgtaccttgagacagacccttctggaagagacaagaggacaccaattgtcatcataaaacagggccatgagccacccacattcacaggctggttcctgggctgggattccagcaagtggtaaattggtatttgtaaaaagcaaacaaacattacaaggcagttatctcattgctgttttgggagaggaacgggaaaagctttttgcttatttgtcttttgaaaattaaggctgggcgcggtggctcacacctgtaatcccagcactttgagaggatgaggtaggcggatcactggggtcaggatttcgagaccagcctggccaacatggcgaaacctcgcctctactaaaaatacaaaaaaattagctgcgcgtggtggtgcacgcctgtagtccctgctacttggaaggctgagacaggaaaattgcttgaacccaggaggctgaggttgcagtgagccaggattgcgccaccacactccagcctgggcaacagagactctgtctcaaaaaaaaaaaaaaaaaaaattaacctcaaccaaacgcctattttttaatgcttagttttggcttgaaattcttcttcacctggagttttcttacgttaatacattaaaataacctgaaggaaactttcgttatgggccaatattagctcttatggaaactgatttatatcttttttatgacctttcaaaagtaaaatactatgcataatctagaaagatttgtcagataggaaattttataatgcattagccattagtcagagttgttttttaacatgccagagaaaaagttgtaatgccttggaagttattctcttttctatagattgtgttcaaaagatgtgtatacttgcaataaggtttatgttaaggtggctttaacaattggttgctattttccttctttagtcaatatgactttgatgtcattaactgctaagtgttattttctaagaggaattttatcttttttttaaccttattaaaagcctttgaaaacacagctctttcatgacaaaatgaattgtattgttatccacttagatacatgtacatgtacagtacatgtttaatatcacaggagatcaaaaagacaatgcacaggggagtatcccagggagcagagccaagttcaagtaagttaacgatatcaagttacttactggcaggtagccactagagaatcttagcaatttttgtcctgcaagatttcagcaaagctacagaaaagtgagtttttatgttttccattcttcccttttctaagtaataatttttatcgcagttaccctgattctattccattccattctattctattctattatttcattctattttatttccaatataccattgtatatcagtatatactgatacactgagtggcagttgcattatctactaatctatataggtcattgaaaaagaagaagctacgttagaacccatggaaagaactttgcctcatgtagagattctagattcttagccaaaagctcagaattgttgggccctaaaggatgaacaatgtagggtccaacaattcatcccacatgaatttttctcatccttcatgtggaatgaaaaaactaaagagacaactgacttaccacacaaatggactatggtagaagctgctgtcccttagtattgaatatctctattttcttttaatcatagaattcactgatattttagcagataatgtggccgtccaggcaggcatgagatttctcagccttacttcaacttgattatgaccatgtgacccaattctgacatttgcctaaaggaaaatttacctaaaaaggcgttttcttgctatggcagtgtaacctgtactaataaatatagtgctagtcctgcatgcaacaaaaatgatgtaagtagacatttaacatttctaggaatgtaattgagtgaaaaataatttttaaaaatatttataaatatcttctgggtcaagctgaatattttttgaaggatgatgagaataaaatgatttaataagtagtactttttcacaaaattagtaaaggtcaaggtgagtggcttagggtacactgtattttacgatgtttctctagtttagccagtggtttttctcatctccaatttatagcacaggccgaggcatatagtagggtctcagttaatatttattgaatggcaatatcaaaaatgagatcagcagcaagatgataaggcagaataaaagttgctgagagcctaaaatgattattcagttctgttgcagggttttaacctgcccaaaggatggaaaaagaagaacataagcataatttctgaatgcatcacggcaaagatgcatgtactcatgaagcataaaattaaaaatatgatacattcactacatgaaaatatgatatacggtttttcttcagtatccgcgggagattggctcgaggaaccccatggataccaacatccttgaatgctcaagtcccttatataaaacggcatagtatttgcataaaacctataccattctcctgtatactctaagtcatctctgcgttacttataatacctaatacagtgtaaacgctgtgtaaacagttgttatactatattggttttttaatttgcattacttttgtattgttgtattattttattgtttttccccaaatagttttgatccgcagatgtagaacccacagatatgataaatcaactgtatctagtacccaaaacagatgagtaacttagaaattaatatgtaatacatacagctaatgttatagctacttaaggaattcctttcactgaaaagaaactcttacaaatcaatgagtcaacaacccaatggaaaaatggccaaaagacatgaatagaagttcacagaaaagaatgaaaatgaccagtaaataatgaaaagatgttctaagacactcttaattaaataaattcacaataaaataatcatacttttatctatctaccagattagcaaatgttaaaatattaaaatgttagtggtcatcaaaatgtagggttacaggttcacccatacactgttaatagatgtataaactggtcaaaactttttgatccatagcacagtattacttttgtaaacatacacaaaaaatattatatatttgccaaacgtatgtactaatctaaaaccaaacacattagactaggtacatgtggagaaagagatacaggtgttccctagcaagttaatatgcttgtgtctcttcaaaccaatatattggcatatttatctaatatttaatcagaagaaagaaagaacagaaagacccaggaagcctactgttagtagaggtcagcctcatcttttctctctgattcaagaaattcatactcaactcagtcaaacagaggtcctgcatttacctcttggtgccggagagccttggtgagccatttagatcctctgtatcttctcaagcacaatcctcagtgttctcttctcgtcttagatagctcatcaaataatatttcccaccacttatttctagcagttctggtaaagagaatggccttcacattgtattttgaacaatgttttggcctccagtaatgattaggaacacactataaacataaaacatcagtccacttaactcattattcagtcatcaagcaattcttgtcccaatcattctccaaagctatatactgtgaatttatactgttgtgtagtgacacaagcccttctgctgaaaaagtaggtagataattactttgaactgaaagaaaacacttattttattttcttttaaacctaatttattttaaacctaatttatttattttaaacctaatttattttaaacctaatttatttattttaaacatttattttaaacctaattcatttgaactgaacttgaatttaaaagcctacaaatgccccgcatatgtagaattatcattcattccgtgttcttgctcttggataaaacggacaactcagagaaaaaactggcttataaatgcacttcacaaaaactgttagaaaagtagccattaaacctgtaaaaaggccgggcgcagtggctgacgcctgtaatcccagcactttgaaaggccaaggcggttggatcacgaggccaggagtccgagaccagcctgaccaacatagtgaaaccccgtctctactaaaaatacaaaaaattagctgggcgtagtggcgggcgcctgtaatcctagctactcgggaggctgaggcaggagaatcgcttgaacccgggaggcggaggttggagcgaaagtacgcgccactgtactccagcctgcgtgacgatgagagtctccgtctcgggggaagaaaaaaaaaacctgtaaaaagtggctcaactttaatattcattaggaaatgactaaaatcaaatattttacttggtaatgccaagtaaaaatacaggagaggatatagtgaaactggagcttacatccactacttgggaagtataaattgatacaatgggtttgaacagtttttgtattttctactaaaatgaacatacacatatcctataatccagaaatcccactccatggtgtgtacccaacaaaaatgcatacatgtgtgtactaaaggatataatatgatttttttttttttttttttttttttgagataggttctcactctgttgcccaggctggagtacagtagcgatctctgctcactgcaatctctgcctcctgggttcaagcaatcctcccacctcagtctccccaggagctgggactctaggtgcgtgccaccacgcccagctaattctttgtagagatggggttttgccatgttgtccaggctggtcttgaactcctagactcaggaaatccacctgccttggcctcccaatatgctgggattacaggcatgagccaccgcatctggacacgaatttttaagttttatatatgtgtgtgtatatatatatatatatatatatatatatatatattttttttttttttttttttttttttgcattggcaaaaaaacaaagatattgtttagcaatttccttgtataatgcaatcagtggaagacaaatcagaggtattattttcccttgggcctttgcagcctgtgttgtttttctctttttcatattgatgtgaaaagcagccaagtattatttgacaacatcagtcccttattaagatgttatttctagtttataattgactatggcatttgcatgcatttcatcatgtctccatttcttcggaatgataatttctaatatacttttcttctattataggaataagaattcagtagtcatatttcctgttgcctataaaaaattgatgctttaatttagttaacatgacaaactccatcttatttagagagattatttttgatgttattataataaaaatgacacctttactaaaaatgtctcatcataaattgttttccattatttctgtgctgattgcaaacaatactgaattaaaatatccctgcaagttcactgtgactcaatctaaggttttaataattcatgaaataaaactaatgttgatgttatccaaatcattctaacgccaacttctaggtaaacagtaaacaagaataagcaaatttgagttttcctaattatttgacattgtcattagcttgtgatccttagatggaatatattttgccagatctcacctcccagggaactgatgagctttaactggaatagtagtgagaatgatagagcagggcccttaactccttagaaaggtcaaaggaagaggtgaatgtgggcagggtttcactggagtattgacacaccaaagatgctatgtaggtgaaaatctctcctaatgcattccctttccaacgaacctgagcctggattcttcagtaacacaatgccttctgagaaacaatgttgttccacattttagagttttggcatgcataatggagtttatggcagagttcagaggatacaatgaaacaagaaagggaggcaactgatgttgtttgattatctccattattttgaaggagccaggtgcttggggaacctggttgtacagaaaggtgatgccaagactctcttgtatgattttcctctctagcttggggctgcaccctctgctgtgggaaggagtcctcaaggtattaatatacatcctatcatttattttagatacagatagcattagagtttatcagtaaagttgggcaactcatggaatattacgagtagaaattgtaattactgtagaatgtatagtgttttgaatggctattgtatttttcagcatacaaattcagaggggtgaaagtaggcaatgacaccactatttatgttttttgttgttgttgtttgtttttgttttgttttgttttgagatggagtcttgcactgtcacccaggctggaggacagtggcatgatctctgctcactgcaacctctgcctcccgtgttcaagcgattctcctgcctcagcctcctgagtagctgggattacaggcacccgccaccacacctgactaattttttgtatttttaagtagagacggagttttgccatgttggccaggctggtcttgaactcctgaacttgtgatccaccctcctctgccttccaaagtgctgggattacaggcatgagccaccgcacccagccctatttatgttttttaaaagcaccatttaccacccatttgtctatggacttaatctatgtctctatgagctggtaaacaatagacaggtaaatacagacttggctgtatttgaacagcaccttcaaaaaccagaagccagaaatcaggtagctagatttgtccatgaaagcaggagattcccttaactggtgatgcctgaagttgggataaagagtcttccaaacatgtgccattttggcatggatatctaaagccaccatgatggctttatattaatgaaggaaataagttgcaggataagtatatccatggtcatccaggggaagaaaatggcgtacataacttatataccatatttaacccagagacagatatcacaggtaaacagtgcaaatcactgtccctagtctgagccatatttagtgtcttgaaagagccacagtggctggctaaaatggcacagtggcaaatcctgaccatggactgccctatgcaaaataactagctccccactttacacagagtacaccatgtcaggcctctgagcccaagctaagccatcatatcccctgtgacctgcacatatacatccagatggcctgaagcaattgaagatctacaaaagaagtgaaaattaccttaactgatgacattccaccattgtgatgtgtttctgccccatcctaactgatcagtgtactttgtaatctcccccacccttaagaaggttctttgtaattcttcccacccttgagaatgtactttgtgagatccaccccctgccagcaaaacattgctcctgactccaccgcctatcccaaaacctataagaactaatgataatcccaccaccctttgctgactctcttttcggactcagcccgcctgcacccaggtgaaataaacagccttgttgctaacccaaa

SEQ ID NO: 281 - DNA, 1467 bp, Homo sapiens
gcagagtggagcggccgccggagatgcctgacgcatctgtctgaggagcggtcagtgacgcgatggagcgggcaagggatcgcttacacctgagacgaactacagaacagcacgtaccagaggtggaagtccaagtcaaacgcagaaggactgcctcactgagcaaccaagagtgtcagttgtacccgaggcgttctcagcagcagcaagtacctgtggtggatttccaggctgaactgaggcaggcattcttagctgagacaccaagaggtggttaaagccatattggagtagcgaggaatctgattccaagcaaaaaccaggctccatctactctttgaagcttctgcccagcttgcattgtttctaggagaacctgcgtcatacctttatctatagccttcccctaggtcttcagaagcatcaagttttaactgtggacattggatttggtggaacagcaatcatgactgttggcaagagtagcaagatgctgcagcacattgactatagaatgagatgtatcctgcaagatggccgaatcttcattggcacctttaaggcttttgacaagcatatgaatttgatcctctgtgattgtgatgagttcagaaagatcaagccaaagaatgcgaagcaaccagagcgtgaagaaaagcgggttttgggtctggtgttgctgcgtggggagaacttggtatccatgactgtggaggggccaccccccaaagatactggcattgctcgggtaccacttgctggagctgctggaggccctggggttggtagggcagctggtagaggagtaccagctggtgtgccaattccccaggcccctgctggattggcaggccctgtccgaggagttgggggaccatcccagcaggtaatgactccacagggaagaggcactgtagcagctgctgctgttgctgcgactgccagtattgctggagccccaacacagtacccaccaggacggggcactccgcccccacccgtcggcagagcaaccccacctccaggcattatggctcctccacctggtatgagaccacccatgggcccaccaattgggcttccccctgctcgagggacgccaataggcatgccgcctccgggaatgagaccccctccaccaggcattagaggtccacctcccccaggaatgcgtccaccaagaccttagcatactgttgatccatctcagtcactttttcccctgcaatgcgtcttgtgaaattgtgtagagtgtttgtgagctttttgttccctcattctgcattaataatagctaataataaatgcatagagcaattaaactgtgaggtactgttgtatatatttttttgcctgttgattttgatgagatcttaagttactgtggatgagggtgatgcctattaagcagttgattcaaatcatattctctttaattcttaggataaaaaggttttctgctatcta

SEQ ID NO: 282 - DNA, 4532 bp, Homo sapiens
gcacacctccccgcgccgccgccgccaccgcccgcactccgccgcctctgcccgcaaccgctgagccatccatgggggtcgcgggccgcaaccgtcccggggcggcctgggcggtgctgctgctgctgctgctgctgccgccactgctgctgctggcgggggccgtcccgccgggtcggggccgtgccgcggggccgcaggaggatgtagatgagtgtgcccaagggctagatgactgccatgccgacgccctgtgtcagaacacacccacctcctacaagtgctcctgcaagcctggctaccaaggggaaggcaggcagtgtgaggacatcgatgaatgtggaaatgagctcaatggaggctgtgtccatgactgtttgaatattccaggcaattatcgttgcacttgttttgatggcttcatgttggctcatgacggtcataattgtcttgatgtggacgagtgcctggagaacaatggcggctgccagcatacctgtgtcaacgtcatggggagctatgagtgctgctgcaaggaggggtttttcctgagtgacaatcagcacacctgcattcaccgctcggaagagggcctgagctgcatgaataaggatcacggctgtagtcacatctgcaaggaggccccaaggggcagcgtcgcctgtgagtgcaggcctggttttgagctggccaagaaccagagagactgcatcttgacctgtaaccatgggaacggtgggtgccagcactcctgtgacgatacagccgatggcccagagtgcagctgccatccacagtacaagatgcacacagatgggaggagctgccttgagcgagaggacactgtcctggaggtgacagagagcaacaccacatcagtggtggatggggataaacgggtgaaacggcggctgctcatggaaacgtgtgctgtcaacaatggaggctgtgaccgcacctgtaaggatacttcgacaggtgtccactgcagttgtcctgttggattcactctccagttggatgggaagacatgtaaagatattgatgagtgccagacccgcaatggaggttgtgatcatttctgcaaaaacatcgtgggcagttttgactgcggctgcaagaaaggatttaaattattaacagatgagaagtcttgccaagatgtggatgagtgctctttggataggacctgtgaccacagctgcatcaaccaccctggcacatttgcttgtgcttgcaaccgagggtacaccctgtatggcttcacccactgtggagacaccaatgagtgcagcatcaacaacggaggctgtcagcaggtctgtgtgaacacagtgggcagctatgaatgccagtgccaccctgggtacaagctccactggaataaaaaagactgtgtggaagtgaaggggctcctgcccacaagtgtgtcaccccgtgtgtccctgcactgcggtaagagtggtggaggagacgggtgcttcctcagatgtcactctggcattcacctctcttcaggactgcaaggggcctactctgtcacctgtggctcttcctctcctctcaggaacaaacaacaaaaatcaaatgactctgcttttggggatgtcaccaccatcaggacaagtgtaacctttaagctaaatgaaggcaagtgtagtttgaaaaatgctgagctgtttcccgagggtctgcgaccagcactaccagagaagcacagctcagtaaaagagagcttccgctacgtaaaccttacatgcagctctggcaagcaagtcccaggagcccctggccgaccaagcacccctaaggaaatgtttatcactgttgagtttgagcttgaaactaaccaaaaggaggtgacagcttcttgtgacctgagctgcatcgtaaagcgaaccgagaagcggctccgtaaagccatccgcacgctcagaaaggccgtccacagggagcagtttcacctccagctctcaggcatgaacctcgacgtggctaaaaagcctcccagaacatctgaacgccaggcagagtcctgtggagtgggccagggtcatgcagaaaaccaatgtggtctgtgtcaacctggtgaatattctgcagatggctttgcaccttgccagctctgtgccctgggcacgttccagcctgaagctggtcgaacttcctgcttcccctgtggaggaggccttgccaccaaacatcagggagctacttcctttcaggactgtgaaaccagagttcaatgttcacctggacatttctacaacaccaccactcaccgatgtattcgttgcccagtgggaacataccagcctgaatttggaaaaaataattgtgtttcttgcccaggaaatactacgactgactttgatggctccacaaacataacccagtgtaaaaacagaagatgtggaggggagctgggagatttcactgggtacattgaatccccaaactacccaggcaattacccagccaacaccgagtgtacgtggaccatcaacccaccccccaagcgccgcatcctgatcgtggtccctgagatcttcctgcccatagaggacgactgtggggactatctggtgatgcggaaaacctcttcatccaattctgtgacaacatatgaaacctgccagacctacgaacgccccatcgccttcacctccaggtcaaagaagctgtggattcagttcaagtccaatgaagggaacagcgctagagggttccaggtcccatacgtgacatatgatgaggactaccaggaactcattgaagacatagttcgagatggcaggctctatgcatctgagaaccatcaggaaatacttaaggataagaaacttatcaaggctctgtttgatgtcctggcccatccccagaactatttcaagtacacagcccaggagtcccgagagatgtttccaagatcgttcatccgattgctacgttccaaagtgtccaggtttttgagaccttacaaatgactcagcccacgtgccactcaatacaaatgttctgctatagggttggtgggacagagctgtcttccttctgcatgtcagcacagtcgggtattgctgcctcccgtatcagtgactcattagagttcaatttttatagataatacagatattttggtaaattgaacttggtttttctttcccagcatcgtggatgtagactgagaatggctttgagtggcatcagcttctcactgctgtgggcggatgtcttggatagatcacgggctggctgagctggactttggtcagcctaggtgagactcacctgtccttctggggtcttactcctcctcaaggagtctgtagtggaaaggaggccacagaataagctgcttattctgaaacttcagcttcctctagcccggccctctctaagggagccctctgcactcgtgtgcaggctctgaccaggcagaacaggcaagaggggagggaaggagacccctgcaggctccctccacccaccttgagacctgggaggactcagtttctccacagccttctccagcctgtgtgatacaagtttgatcccaggaacttgagttctaagcagtgctcgtgaaaaaaaaaagcagaaagaattagaaataaataaaaactaagcacttctggagacataataatgtacatttattgccagccttcctcgttgcaagcttccaccctgcagcaaatgcactatgctgactctcgcaccttcagctgtgccctctgacactctgctggccattgcctgagggactggggagttcaggtgaaatgtaatttcctcagtggatgagaatcatcaattgtcatgaaaaggcgatttcaccaaccctgagtcggtattgccaagggttctactccccaagtgggcttcccatcacaagggatctgaggtccaggtgggtgtggtgaggcccagcctgtcatgtatgccttccttccccagtctcaaatgtgagagacggactctgctccgtggacatgagcagccccttgaagggtggtctcattctctaacagtaacagcactgccagaaacaccccctgaatgccacacgatcatctcactttgggtcaggccagcagggcctcacgatcatttcttgaacttgaattttcagtgttattgaatctttaaacatttaaatccccaagcaaaaatctcattacagtgaataaaaaggaatccaatcaaacaagccaccacttccctaatggatggactacctacaactatagtgttttgttatttcaataacaattctatgcacagccaattctccataccaaagtactaaaaaaatgtttaacaagcatttttgaagaaaacaaagagaacttcattatggttaaacttgcttttcatctcagtgttgctttttttaacctgttaataacattgattcttaaaaagtcctaatcaaacttctttatttggatgggccctaaatattcattttcagatttctcttcaaaagtttgaacatcatcattaaaaaaaaaatagcattaaaacaa

SEQ ID NO: 283 - DNA, 1864 bp, Homo sapiens
actcacggaaatgccttggcagagtctggggtccctggactgagccatcagctgggtcactgagacccatggcaaggaaacaaaataggaattccaaggaactgggcctagttcccctcacagatgacaccagccacgccgggcctccagggccagggagggcactgctggagtgtgaccacctgaggagtggggtgccaggtggaaggagaagaaaggactggtcctgctcgctcctcgtggcctccctcgcgggcgccttcggctcctccttcctctacggctacaacctgtcggtggtgaatgcccccaccccgtacatcaaggccttttacaatgagtcatgggaaagaaggcatggacgtccaatagacccagacactctgactttgctctggtctgtgactgtgtccatattcgccatcggtggacttgtggggacgttaattgtgaagatgattggaaaggttcttgggaggaagcacactttgctggccaataatgggtttgcaatttctgctgcattgctgatggcctgctcgctccaggcaggagcctttgaaatgctcatcgtgggacgcttcatcatgggcatagatggaggcgtcgccctcagtgtgctccccatgtaccttagtgagatctcacccaaggagatccgtggctctctggggcaggtgactgccatctttatctgcattggcgtgttcactgggcagcttctgggcctgcccgagctgctgggaaaggagagtacctggccatacctgtttggagtgattgtggtccctgccgttgtccagctgctgagccttccctttctcccggacagcccacgctacctgctcttggagaagcacaacgaggcaagagctgtgaaagccttccaaacgttcttgggtaaagcagacgtttcccaagaggtagaggaggtcctggctgagagccgcgtgcagaggagcatccgcctggtgtccgtgctggagctgctgagagctccctacgtccgctggcaggtggtcaccgtgattgtcaccatggcctgctaccagctctgtggcctcaatgcaatttggttctataccaacagcatctttggaaaagctgggatccctccggcaaagatcccatacgtcaccttgagtacagggggcatcgagactttggctgccgtcttctctggtttggtcattgagcacctgggacggagacccctcctcattggtggctttgggctcatgggcctcttctttgggaccctcaccatcacgctgaccctgcaggaccacgccccctgggtcccctacctgagtatcgtgggcattctggccatcatcgcctctttctgcagtgggccaggtggcatcccgttcatcttgactggtgagttcttccagcaatctcagcggccggctgccttcatcattgcaggcaccgtcaactggctctccaactttgctgttgggctcctcttcccattcattcagaaaagtctggacacctactgtttcctagtctttgctacaatttgtatcacaggtgctatctacctgtattttgtgctgcctgagaccaaaaacagaacctatgcagaaatcagccaggcattttccaaaaggaacaaagcatacccaccagaagagaaaatcgactcagctgtcactgatggtaagataaatggaaggccttaacaagtttcctcctccacgttggacaattatgtcaaaaacaggattgtctacatggatgatctcacttttcaggaaacttaaaatttacccattattgggaagcttaaatgaattgaagctatgcaagtcttttatattattaaatatttaaaagtaaacctgtactaatctaa

SEQ ID NO: 284 - DNA, 5361 bp, Homo sapiens
tttctccttccctccacgggccgggtgagaaagtagccgggggctatcccgacccggcggttcttggggagggggccgaacaagaaaagggaggagatggagataacttccccggatttagcttttttgtctttgtttttgttctcaccacttccatcggatgactggagagtaaaagggaacccggagcggggtggcgagcagcgctttgagaaaatgcaggagtgtgtttggagacgcgtaaagttgcctttcaagctctggcctccgggcacgcgatgctccgcggcgggctgactcagggctgccttgggcctccctgccaccctcctggaaatgatgcaagtcctgactgtcacctggatccctgcagcccagcctggaatgcgtctggattaggggaaagacgagaaacgacactccaggtgttgcacggcccaccaaagcgggaagatagggcagttgctcagaccaaatactgtatctagtgcttctgctcctatcttcaatcgtggggttctttttaatgcaaagtgtcacaaggccaggaattcccatgtgtgctcagttggcccacagcatcattgtgcctaggaaactgcttcaatttatcaagtcctctgggctgggaatctcactgaattccaaacggcggaaagaggaaactttcccaacccgatgtgggtgtgacgcgagccaggggccccagggacactgtcccagagcacaccgtccccctttaacagcaactggagcttggattcgctcttatattgtacagtcctttcgaccattgccctggagcacccgcacacgcgcacgcatctccggccgcgctcacacacactcatacacacgcacgcaaacgcgtggccgccgccaggtcggcaactttgtccggcgctcccagcggcgctcggcttcctcctgtagtagttgagcgcaggccccgcctcccggccgtgttgtcaaaagggccggggtctcggattggtccagccgccgggacaacacctgctcgactccttcattcaagtgacaccagagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggaggaggaggggaagcggcgaaggaggaagaggaggaggaggaagaggggagcacaaaggatccaggtctcccgacgggaggttaataccaagaaccatgtgtgccgagcggctgggccagttcatgaccctggctttggtgttggccacctttgacccggcgcgggggaccgacgccaccaacccacccgagggtccccaagacaggagctcccagcagaaaggccgcctgtccctgcagaatacagcggagatccagcactgtttggtcaacgctggcgatgtggggtgtggcgtgtttgaatgtttcgagaacaactcttgtgagattcggggcttacatgggatttgcatgacttttctgcacaacgctggaaaatttgatgcccagggcaagtcattcatcaaagacgccttgaaatgtaaggcccacgctctgcggcacaggttcggctgcataagccggaagtgcccggccatcagggaaatggtgtcccagttgcagcgggaatgctacctcaagcacgacctgtgcgcggctgcccaggagaacacccgggtgatagtggagatgatccatttcaaggacttgctgctgcacgaaccctacgtggacctcgtgaacttgctgctgacctgtggggaggaggtgaaggaggccatcacccacagcgtgcaggttcagtgtgagcagaactggggaagcctgtgctccatcttgagcttctgcacctcggccatccagaagcctcccacggcgccccccgagcgccagccccaggtggacagaaccaagctctccagggcccaccacggggaagcaggacatcacctcccagagcccagcagtagggagactggccgaggtgccaagggtgagcgaggtagcaagagccacccaaacgcccatgcccgaggcagagtcgggggccttggggctcagggaccttccggaagcagcgagtgggaagacgaacagtctgagtattctgatatccggaggtgaaatgaaaggcctggccacgaaatctttcctccacgccgtccattttcttatctatggacattccaaaacatttaccattagagaggggggatgtcacacgcaggattctgtggggactgtggacttcatcgaggtgtgtgttcgcggaacggacaggtgagatggagacccctggggccgtggggtctcaggggtgcctggtgaattctgcacttacacgtactcaagggagcgcgcccgcgttatcctcgtacctttgtcttctttccatctgtggagtcagtgggtgtcggccgctctgttgtgggggaggtgaaccagggaggggcagggcaaggcagggcccccagagctgggccacacagtgggtgctgggcctcgccccgaagcttctggtgcagcagcctctggtgctgtctccgcggaagtcagggcggctggattccaggacaggagtgaatgtaaaaataaatatcgcttagaatgcaggagaagggtggagaggaggcaggggccgagggggtgcttggtgccaaactgaaattcagtttcttgtgtggggccttgcggttcagagctcttggcgagggtggagggaggagtgtcatttctatgtgtaatttctgagccattgtactgtctgggctgggggggacactgtccaagggagtggcccctatgagtttatattttaaccactgcttcaaatctcgatttcactttttttatttatccagttatatctacatatctgtcatctaaataaatggctttcaaacaaagcaactgggtcattaaaaccagctcaaagggggtttaaaaaaaaaaaaccagcccatcctttgaggctgatttttcttttttttaagttctattttaaaagctatcaaacagcgacatagccatacatctgactgcctgacatggactcctgcccacttgggggaaaccttatacccagaggaaaatacacacctggggagtacatttgacaaatttcccttaggatttcgttatctcaccttgaccctcagccaagattggtaaagctgcgtcctggcgattccaggagacccagctggaaacctggcttctccatgtgaggggatgggaaaggaaagaagagaatgaagactacttagtaattcccatcaggaaatgctgaccttttacataaaatcaaggagactgctgaaaatctctaagggacaggattttccagatcctaattggaaatttagcaataaggagaggagtccaaggggacaaataaaggcagagagaagagacagaactaaaaatacgaggaaaggagagtgaggattttcattaaaagtctcagcagtgggtttcttgggttatttaaaacatcacctaaataggccttttcttcctaattggccatcaaattaaagcctatcctttctcaagcaggagctggtattgtagggagtggccgggtattctgggctgggctcttctggagtagggggtcagcaaacattgtctgcaaagggccagatactgaatccagtactttcagtttggcgagccgtgaggtctctgtcgaaactactcaactctgccgtcctagcacaaaagcagccatagacaacacacaaacgagagggcttggctcccttccaggaagatttatttaacaggctcccagctgaatttcactcacaggacacagtttactgatctctgttctagtgagtgggtcaaaaagcatatgcatccttatccgtcaactcatcagctcttcctcaaggcaacctgaggccagacaccaagaaaccaagcgtatctgctctaaaatgacttgttcctggggaatgccttcaaccaaaacacagctagtatttctatgccccaaatccaatcccagtctttcatgatccatgccggcggttgggtggggaggggaatcattggttgggggaagggaggaaaccccacctccagcccccgccaccgggctccctgggcacccagcaagatctggggctgcagagaacagaagagctggtgcacttaatccagctctgcccttggggggaggaggacctgtgtgtcaggctctgccatgggaacgagtgtaaaccgtggctgtctcctgcagtgagccaccgcggcaggcacgttgactgttttactgacatcactcaaaagctaaagcaataacattctcctgcgttgctgagtcagctgttcatttgtccgccagctcctggactggatgtgtgaaaggcatcacatttccattttcctccgtgtaaatgttttatgtgttcgcctactgatcccattcgttgcttctattgtaaatatttgtcatttgtatttattatctctgtgttttccccctaaggcataaaatggtttactgtgttcatttgaacccatttactgatctctgttgtatatttttcatgccactgctttgttttctcctcagaagtcgggtagatagcatttctatcccatccctcacgttattggaagcatgcaacagtatttattgctcagggtcttctgcttaaaactgaggaaggtccacattcctgcaagcattgattgagacatttgcacaatctaaaatgtaagcaaagtagtcattaaaaatacaccctctacttgggctttatactgcatacaaatttactcatgagccttcctttgaggaaggatgtggatctccaaataaagatttagtgtttattttgagctctgcatcttaacaagatgatctgaacacctctcctttgtatcaataaatagccctgttattctgaagtgagaggaccaagtatagtaaaatgctgacatctaaaactaaataaatagaaaacaccaggccagaactatagtcatactcacacaaagggagaaatttaaactcgaaccaagcaaaaggcttcacggaaatagcatggaaaaacaatgcttccagtggccacttcctaaggaggaacaaccccgtctgatctcagaattggcaccacgtgagcttgctaagtgataatatctgtttctactacggatttaggcaacaggacctgtacattgtcacattgcattatttttcttcaagcgttaataaaagttttaaataaatggcaaaaaaaaaaaaaaaaaa

SEQ ID NO: 285 - DNA, 5102 bp, Homo sapiens
gcgatcgcggcggcggcggcggcggcgaggagctgtgccttccacctctccagccccggcaggacgggggcggccgccgcgaacccggggcggggacagcacgcagcctcgaggcgcgcacccccgcccggcagcggccccgacacccggggcgagcgggaaagcggcagcggcggcggcggcggcggcggcgggggaaggatgcaggggaagaagccgggcggttcgtcgggcggcggccggagcggcgagctgcagggggacgaggcgcagaggaacaagaaaaagaaaaagaaggtgtcctgcttttccaacatcaagatcttcctggtgtccgagtgcgccctgatgctggcgcagggcacggtgggcgcctacctggtgagcgtcctgaccaccctggagcgtaggttcaacctgcagagcgctgacgtgggtgtgatcgctagcagcttcgagatcgggaacctggcgctcatcctcttcgtgagctacttcggggcacgcgggcaccggccgcgcctgatcggctgcggcggcatcgtcatggcgctgggcgcgctgctgtcggcgctgcccgagttcctgacccaccagtacaagtacgaggcgggcgagatccgctggggcgccgagggccgcgacgtctgcgcagccaacggctcgggcggcgacgaggggcccgaccccgacctcatctgccgcaaccggacggctaccaacatgatgtacttgctgctcattggggcccaggtgctcctgggcatcggtgctacccctgtgcagcccctgggcgtctcctacatcgacgaccacgtgcggaggaaggactcctcgctctatataggaatcctgttcacgatgctggtatttggaccagcctgcgggtttatcctgggctctttctgtaccaaaatctacgtggatgcggtcttcattgacacaagtaacctggacatcactccggacgacccccgctggatcggagcctggtggggtggctttctgctctgcggtgccttactcttcttctcttccctcttgatgtttgggtttccacagtccctgcccccgcactcagagcccgccatggaaagcgagcaggccatgctctccgaaagagaatacgagagacccaagcccagcaacggggtcctgaggcaccccctggagccagacagcagtgcctcctgtttccagcagctgagagtgatcccgaaggtcaccaagcacctgctctcaaaccctgtgttcacctgcatcatcctggccgcctgcatggagattgcagtggtggctggcttcgctgcctttttggggaagtacctggagcagcagtttaacctcaccacctcttctgccaaccagctgcttgggatgactgcgatcccgtgtgcttgtctgggtatcttcctgggaggtcttttggtgaagaagctcagcctgtctgccctgggggccattcggatggccatgctcgtcaacctggtgtccactgcttgctacgtctccttcctcttcctgggctgcgacactggccctgtggctggggttactgttccctatggaaacagcacagcacctggctcagccctggacccctactcgccctgcaataataactgtgaatgccaaaccgattccttcactccagtgtgtggggcagatggcatcacctacctgtctgcctgctttgctggctgcaacagcacgaatctcacgggctgtgcgtgcctcaccaccgtccctgctgagaacgcaaccgtggttcctggaaaatgccccagtcctgggtgccaagaggccttcctcactttcctctgtgtgatgtgtatctgcagcctgatcggtgccatggcacagacaccctcagtcatcatcctcatcaggacagtcagccctgaactcaagtcttacgctttgggagttctttttctcctccttcgtttgttgggcttcatccctccacccctcatcttcggggctggcatcgactccacctgcctgttctggagcacgttctgtggggagcaaggcgcctgcgtcctctacgacaatgtggtctaccgatacctgtatgtcagcatcgccatcgcgctcaaatccttcgccttcatcctgtacaccaccacgtggcagtgcctgaggaaaaactataaacgctacatcaaaaaccacgagggcgggctgagcaccagtgagttctttgcctctactctgaccctagacaacctggggagggaccctgtgcccgcaaaccagacacataggacaaagtttatctataacctggaagaccatgagtggtgtgaaaacatggagtccgttttatagtgactaaaggagggctgaactctgtattagtaatccaagggtcatttttttcttaaaaaaagaaaaaaaggttccaaaaaaaaccaaaactcagtacacacacacaggcacagatgcacacacacgcagacagacacaccgactttgtcctttttctcagcatcagagccagacaggattcagaataaggagagaatgacatcgtgcggcagggtcctggaggccacttgcgcggctgggccacagagtctactttgaaggcacctcatggttttcaggatgctgacagctgcaagcaacaggcactgccaaattcagggaacagtggtggccagcttggaggatggacatttctggatacacatacacatacaaaacagaaaacattttttaaaagaagtttcctaaaataaaaaaaattaaaaaaaaaaaacccacaagttgaaaacattgccagattaagcactagtgacacaccccgtgccaccctcttcctccaggtgggggtgggggcgggcgcacaagtcggaggggtggaagcaccactcctctctctgactttcgcaatatgggtcactgtgtagacgactcacccagtctgcatgtggttcaaggccccagagttctctcagtgatgctaatgggtgatccgtgctggagtttgtaattggcacctctcaccagctccatttccatgttcaagactgagggcctgagggggagccaggtggggggccagcacctcccagtggcgggcatccaccttcccccagccccacagagtgacctcaggaagcagtaggcctcgcctggctatgactgacccggctcagagctggtgagacccaacgcagtccaagtcatttgcttacatttgccaaaaacattttgccatttttaaaagaaaaaaatacaatccatatgaatttcaaactgttgtatgtataatcctctaatactatttttaactacttctaaaatctgtgttaacccttcaagtcactaacacagttctctaggccggatttattatgctggttgcttttactttttttctccttttttaatgcaccaaaaatatgtgatacaagggatgcaattaacctattgtaattttcatcattttatcctcattcgaatattctacaaaaacaagaatatacaatgtgttacaagaagaaaaaaaaatgcttcaaaaagagagtgtatatgcagcctgcctttaaaagaatcacatttgagacaacaggggataatgtgatgaattgcaaatttgccttttagcttccttccccatgattcagtgatcactgtcacgggaaacccttttatattcatgcttgacattccaagaggcgttcttttcagcctgtggaggagacactcttagatgtgggtttgtgtgtatgggtgcaacacttccggggataggaaagaagaacagttccctaacacaagctgttaagaagtctgtagcatctctgataacgaatagacccacaagctcctggaagctgtcgtgtgtccaatgcgtgaaaatgtctgtgacattttcagtgttagtcttgaactaaggcccttgtctgtgtgttttgaaggtgggtgaacctcagagaatgaacctgttatgatttggggtaagaatcacgttggaaaacctctcgcaaccagcacactaggccttctacggccatttctgtaaggggacagagcttaggtaaaggcacacactcatacacacacaacaaagggccctgctaacttactcctcatgctgcttcagtgacctttgttcatgtcacattcctggcgctggaaaaaaaactcaaaggttgattggtttgctttttcaccttggacacatttgcattttacccacaaggcaaacaaaagaatcaggaagtaaaaaatggttgggagtgggacaggtatggtaccgaatttttaatgaacattgtaaatgaagaggcttgaatgacagcccaaatctagagaaggcactcagcaagaccaaccaaaagaaaagctgtgtcgtggtatggggccaccgtgatcagctacctggggcaggatgcttctgagacaggcctttcaactgcttagtgttagtatgtccttgcttatgaaaatggggacactcatcagtacgttaactactaaaggggagatggttctccaaccacttcataaaatatgtatgttctgttgttcctaaggctttgataatatcctgtacagattttggtttagttttgcaaatatattgctaataggtcactcttatagattattgcttggcccttcaaactcagtacacacacactgaggccctttgacctagtgttttatggaactatttgctttgagagaaaaaaaaaagaaagttttttaaactctttgcattttggattttttttcctaagattttaggatgaatgtgaaaaagatgttagaataacaggaagacaactccagggctgagttttatcagcaattgggtataaatttaaagaccgctgttgcaggatggctctgaattctgttgtgtcgtcttttaaaattttaattattctcatatagtaccgaacagaaaactcagtctagttttaatttgccttttgtgctctaaagaagcattgtacatacaacactagatccagcccctcgattatctgtttggtttcaagtgaatgaaaagatttcctggtaagatcattggatttacagaatacaaaaatgtacgggatggaataaacctagaaagtgaa

SEQ ID NO: 286 - DNA, 6481 bp, Homo sapiens
agacgcgcctccaccgccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagcatgaacttatcatacctcagtggaagacttcagaaagccccgtgagagaaaagcatccactcaaagctgagctcagggtaatggctgaggggcgagaactgatcctggacctggagaagaatgagcaactttttgctccttcctacacagaaacccattatacttcaagtggtaaccctcaaaccaccacacggaaattggaggatcactgcttttaccacggcacggtgagggagacagaactgtccagcgtcacgctcagcacttgccgaggaattagaggactgattacggtgagcagcaacctcagctacgtcatcgagcccctccctgacagcaagggccaacaccttatttacagatctgaacatctcaagccgcccccgggaaactgtgggttcgagcactccaagcccaccaccagggactgggctcttcagtttacacaacagaccaagaagcgacctcgcaggatgaaaagggaagatttaaactccatgaagtatgtggagctttacctcgtggctgattatttagagtttcagaagaatcgacgagaccaggacgccaccaaacacaagctcatagagatcgccaactatgttgataagttttaccgatccttgaacatccggattgctctcgtgggcttggaagtgtggacccacgggaacatgtgtgaagtttcagagaatccatattctaccctctggtcctttctcagttggaggcgcaagctgcttgcccagaagtaccatgacaacgcccaattaatcacgggcatgtccttccacggcaccaccatcggcctggcccccctcatggccatgtgctctgtgtaccagtctggaggagtcaacatggaccactccgagaatgccattggcgtggctgccaccatggcccacgagatgggccacaactttggcatgacccatgattctgcagattgctgctcggccagtgcggctgatggtgggtgcatcatggcagctgccactgggcacccctttcccaaagtgttcaatggatgcaacaggagggagctggacaggtatctgcagtcaggtggtggaatgtgtctctccaacatgccagacaccaggatgttgtatggaggccggaggtgtgggaacgggtatctggaagatggggaagagtgtgactgtggagaagaagaggaatgtaacaacccctgctgcaatgcctctaattgtaccctgaggccgggggcggagtgtgctcacggctcctgctgccaccagtgtaagctgttggctcctgggaccctgtgccgcgagcaggccaggcagtgtgacctcccggagttctgtacgggcaagtctccccactgccctaccaacttctaccagatggatggtaccccctgtgagggcggccaggcctactgctacaacggcatgtgcctcacctaccaggagcagtgccagcagctgtggggacccggagcccgacctgcccctgacctctgcttcgagaaggtgaatgtggcaggagacacctttggaaactgtggaaaggacatgaatggtgaacacaggaagtgcaacatgagagatgcgaagtgtgggaagatccagtgtcagagctctgaggcccggcccctggagtccaacgcggtgcccattgacaccactatcatcatgaatgggaggcagatccagtgccggggcacccacgtctaccgaggtcctgaggaggagggtgacatgctggacccagggctggtgatgactggaaccaagtgtggctacaaccatatttgctttgaggggcagtgcaggaacacctccttctttgaaactgaaggctgtgggaagaagtgcaatggccatggggtctgtaacaacaaccagaactgccactgcctgccgggctgggccccgcccttctgcaacacaccgggccacgggggcagtatcgacagtgggcctatgccccctgagagtgtgggtcctgtggtagctggagtgttggtggccatcttggtgctggcggtcctcatgctgatgtactactgctgcagacagaacaacaaactaggccaactcaagccctcagctctcccttccaagctgaggcaacagttcagttgtcccttcagggtttctcagaacagcgggactggtcatgccaacccaactttcaagctgcagacgccccagggcaagcgaaaggtgatcaacactccggaaatcctgcggaagccctcccagcctcctccccggccccctccagattatctgcgtggtgggtccccacctgcaccactgccagctcacctgagcagggctgctaggaactccccagggcccgggtctcaaatagagaggacggagtcgtccaggaggcctcctccaagccggccaattccccccgcaccaaattgcatcgtttcccaggacttctccaggcctcggccgccccagaaggcactcccggcaaacccagtgccaggccgcaggagcctccccaggccaggaggtgcatccccactgcggccccctggtgctggccctcagcagtcccggcctctggcagcacttgccccaaagtttccagaatacagatcacagagggctggagggatgattagctcgaaaatctagacctgtccaaggggcttctccctttccttgagctctctggacactgcagaggacccatggccatggaaccctgaagaagcatgtctggccgcctctgagctcctcccaccctcctccaggaacctccacatctccaaaaatctccctgttgactcagtgcctcctcggcttccttggaagcccagagggactatgatctgatggcctctaggtgttgttttgtgcaatatacagccccaggtagggaggggagagtatgaggagggtgactggcagcttctcctccagactcctagccccgaggtgctgatggagatgctcaaggccagcaagcccctcaggccagcacttcgcttgcagaagccatccattcactcctggggtgcagggcacgcaagagagcttcccattgcttctgctctcctcagaggtcccgggctggatggaggctggtacttacccaccccttttagcttttagggattaaggaagggtcaagccagccactgctgtggccctgcccagggcttggttgagggaacggcttctggctgtatggctgcatgtgacaagccacgtcccctcccacctctccccaaacccctgcatccctgtattcacacgggtcactctgactcagacaggtactattcgtaggcagtgtagacagcaggaggagcaccgggcttgggcttcctctgagccgtgatgccaaaggttgcgactcctgactctggataatttttagttgctctttgttttctctgccgcactttcctggtgccccacgcttttctctcttccttcccctctcattctccctctaatgtgtggtgctttggtgagcaaaccctcagcagtcctgaccttcgggtgaccaggtgcttgtgacctacaagtcagagtcctctctcacagtcggccactggatttccctcactggctctcaggagtgtgaccagagtagacttggggcatggccattggggtcatatgtttatttttcattgtgttttgtgacctcagcagggtgggggtcttcctccttactctaagctaaatctaggtgaggtttccccttagggagcccagctatttacaaagtacacacgagggagcaggctggtcattgacttcgggctggaccgttgccctctgagcagagaacagacccatttctgggagctgcccgagatcactggagaaggcagccagcagcagctgcactggaacagtcagagcagggagcctcttcctcaacccagctttttgtcattcacttccttttgttctctctctggtcactgcccttacctgaccctcacagaaagagagctctgagcaggtgagggggtctgcggtggctcctgtcttccctgcagcagggaaggagggccgtgtggtgctttgctagataggacggtttttgcaaagcacctggagatgtttgctgggagatagactcccactccacaaaggtgctgggtggctctccggacaggagctggcctgactctcactcctctgaggctttcctggggcctcctcccatcctgccatgagcaattgtttgctcttgaaaacctcactgcaaggctgaggctgagcttctgattcaccaccccagggcctccttatagttctctgcacacaataggtgcttcttggatgttcttgggtttggaaataagtggaaaatacgggatgtacccctgggggaaaagcctgggttgggtttagaaagatctcaggaaaatgagtttctcttccctcagggtggctgtgatacaggttccccatgtccttgccgtgggtcatccttgctgtgggtcatccttgctgtggagatccattccccacctttcctgtggcccaaccttttatttaaatgtgctaccctctgcctcaaggcttggttcctggaaagtaaaggtgaaaacatcccctttcacccctctgcaaaacaaacaagcaacatcctcaaaacccaaccccatgcctcacagagcttcctgtggcttctccagcctttctccctcacatcaggaggtagatagctctgaaatgacagcgccacagccatagtgactgcatgagccatctgaacctgcagtccaccctccctggaaccacaccagaaagagacctgggttgtcgttttcttgctttttgttttgttttgttttattattttcatatcacctccatcccataaagttgtactgtgaactggaagatggtggaatgttttggaatttgatagactttcggcaaccagttctactaatgcttcactcctggctctgttcagggaggctgcccaggaggaagactggccattatgcatccccttttctttccagtgcccagtatgctgttttgaggtgtcaaatacaaataaatctgggcttagggaaggagagaccttattccaaagcacgattgcagaaggggaaagggaatattgcaaaagggagaggaaggggccttatgggaatagtgaaaaggctcagaccgaccgatggcaagatctgcaagcgtctcaaagcccaggcagaaaaggacttttcttttattggaagaagtaaacatggctagaaagaaccacgttcagggaatgacgttgtgcccagcctttttttttttttttttttttttgtctccaggggaggggctgtttgctggctcaggctgaggatggcccaaagtccagggtctggtggggaggagggaagcttaactcaagtttgggttagtgagttagcaagctctttgtgcagatggggatgtaggtaaatctttttaaaagtgaaattaacctcctgccaattttacaacccaagaatttttttttaagggccttggagccatctctaaaacaaacctcaagggatttagtgccctgtctccctgtctctagaagccttagcctgggcacctggctcaatcttgtaactgcctgctagccatagattcctttcagccttgctgacttctccctataaaagtaaagcctttttctgccccagctctgagacacttgcagatcttaaggtctgagacttgctgattttctggttggagtgtttttttgtattgccatagtcccttccccctgaagcaatagcccctccccacctcctgcaatacgcctttccaatctttattggaagtctctccctgcctacttcctaatttattcttatttgacagagggtatggaagacttgcaatttgaaaactggggaccagttccaaagtcagtaattgtgttaaccacgtgtataacagctctgctggacacccaagaaagccatgggaacgccaactggaaaggtccccttccccaggggagcctgcgaaggagaggttctgtagaatccaagcccacatttccaaagtcacccccaacgcgtcctctcacaccgtccactgtgcgtttgtatgtgtctgggatccagggcaatgtgaattttctttttatttgggagattgttcacggaaaacagatcttcttctctcttgtccacctattaattgtttacaatatttgtacatctatgcaaaatacttgaatgggccatggtgccttttttccttgttagtatttaattaaaaatgaattgtttgtcatttgcaatgtta

SEQ ID NO: 287 - DNA, 1885 bp, Homo sapiens
gggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtg

SEQ ID NO: 288 - DNA, 1838 bp, Homo sapiens
acccttgtttcctgtccctgtcgcgcccaggtgtttacctggcactcaggtgagtggtgcgctctggctgttttctgtcggagccgcccgcctcttccttcagcgcgtcccacaaatcccgacggcacggaggggccccaggccaagggcgatgggcccctgagccctgacaccgcttcgccgctgctgcaggtgcccctggccggcagcgccgccgtggtcccggagcgcggcgacatgccggagctggtggtgaccgcgctgctggcgccgtcgcgcctgtcgctgaagctgctgcgcgccttcatgtggagcctggtgttctcggtggcgctggtggccgcggcggtctacggctgcatagcgctcacgcacgtgctgtgccggccccggcgcggctgctgcgggcgccgtcggagcgcgtcccccgcctgcctgagcgacccctcgctgggtgagcacggtttcctgaacctcaagagctcgggcctgcgtctgcactatgtctcggctggacgaggtaacggacccctcatgctgtttctgcacggcttccctgagaactggttctcctggcgttaccagctccgggagttccagagccgcttccatgttgtggctgtggacttgcgaggctatggcccctcggatgcacctcgggatgtggactgctacacaatcgacctgctgctggtggacatcaaagatgtcatcctaggcctgggttactcgaagtgcatccttgtggcccatgactggggtgccctccttgcctggcatttctccatctactacccatccctggtcgagcggatggttgtggtcagtggtgcccccatgtcggtgtaccaagactattccctgcaccacatcagccagttcttccgttcccactacatgttcctgttccagctgccctggctgcccgagaagctgctgtctatgtctgactttcagattctgaagaccaccctcacccaccgcaagacaggcatcccatgcttgacccccagcgagctcgaggccttcctttataacttctcacagcctggtggcctcactgggcccctcaactactaccgaaacctcttcaggaacttccccctggaaccccaggagctgaccacacccacattgctgctgtggggggagaaggacacttacttggagctggggctggtggaagccatcggcagccgctttgtgccgggccgcttggaggcccacatcctgccaggcatagggcattggatcccacagagcaacccccaggagatgcaccagtacatgtgggccttcttgcaagacctgctggactagtggtccttgctggcctgcccaggaggcatggatactcaggaaggaacacacacccattatctgtgtgtgcctgggagtccatacaatgtccatacatgggtgaactcttgaatcgctcataggcatgggactcctggatcccacacaagcgcacctatgggtgcctcgggacacaccaacccctatactcacacacaggcatggatgcatgtgtgtgtaacaaacactttgaccctgggaactgggtatacctctcttccagtggagccagatgccgagaccgagtgtcccacctcctcccttcctggggcctcactctgcgctttgccaaagtcgcttctctgccatagctgcacagaccttaaaccctgaccttcctgtccctgccttcgacctcctgcctgggtcttcagctcagtgctactctgaatacaatactgctgaccacatttggctacttcagcttaaatgtatgttaattgaaatgaaatacaatgaaaatgcagtgctcagtccca

SEQ ID NO: 289 - DNA, 2696 bp, Homo sapiens
gtcctggcttcagcttccaactacaaagacagacttggtccttttcaacggttttcacagatccagtgacccacgctctgaagacagaattagctaactttcaaaaacatctggaaaaatgaagacttgggtaaaaatcgtatttggagttgccacctctgctgtgcttgccttattggtgatgtgcattgtcttacgcccttcaagagttcataactctgaagaaaatacaatgagagcactcacactgaaggatattttaaatggaacattttcttataaaacattttttccaaactggatttcaggacaagaatatcttcatcaatctgcagataacaatatagtactttataatattgaaacaggacaatcatataccattttgagtaatagaaccatgaaaagtgtgaatgcttcaaattacggcttatcacctgatcggcaatttgtatatctagaaagtgattattcaaagctttggagatactcttacacagcaacatattacatctatgaccttagcaatggagaatttgtaagaggaaatgagcttcctcgtccaattcagtatttatgctggtcgcctgttgggagtaaattagcatatgtctatcaaaacaatatctatttgaaacaaagaccaggagatccaccttttcaaataacatttaatggaagagaaaataaaatatttaatggaatcccagactgggtttatgaagaggaaatgcttgctacaaaatatgctctctggtggtctcctaatggaaaatttttggcatatgcggaatttaatgatacggatataccagttattgcctattcctattatggcgatgaacaatatcctagaacaataaatattccatacccaaaggctggagctaagaatcccgttgttcggatatttattatcgataccacttaccctgcgtatgtaggtccccaggaagtgcctgttccagcaatgatagcctcaagtgattattatttcagttggctcacgtgggttactgatgaacgagtatgtttgcagtggctaaaaagagtccagaatgtttcggtcctgtctatatgtgacttcagggaagactggcagacatgggattgtccaaagacccaggagcatatagaagaaagcagaactggatgggctggtggattctttgtttcaacaccagttttcagctatgatgccatttcgtactacaaaatatttagtgacaaggatggctacaaacatattcactatatcaaagacactgtggaaaatgctattcaaattacaagtggcaagtgggaggccataaatatattcagagtaacacaggattcactgttttattctagcaatgaatttgaagaataccctggaagaagaaacatctacagaattagcattggaagctatcctccaagcaagaagtgtgttacttgccatctaaggaaagaaaggtgccaatattacacagcaagtttcagcgactacgccaagtactatgcacttgtctgctacggcccaggcatccccatttccacccttcatgatggacgcactgatcaagaaattaaaatcctggaagaaaacaaggaattggaaaatgctttgaaaaatatccagctgcctaaagaggaaattaagaaacttgaagtagatgaaattactttatggtacaagatgattcttcctcctcaatttgacagatcaaagaagtatcccttgctaattcaagtgtatggtggtccctgcagtcagagtgtaaggtctgtatttgctgttaattggatatcttatcttgcaagtaaggaagggatggtcattgccttggtggatggtcgaggaacagctttccaaggtgacaaactcctctatgcagtgtatcgaaagctgggtgtttatgaagttgaagaccagattacagctgtcagaaaattcatagaaatgggtttcattgatgaaaaaagaatagccatatggggctggtcctatggaggatacgtttcatcactggcccttgcatctggaactggtcttttcaaatgtggtatagcagtggctccagtctccagctgggaatattacgcgtctgtctacacagagagattcatgggtctcccaacaaaggatgataatcttgagcactataagaattcaactgtgatggcaagagcagaatatttcagaaatgtagactatcttctcatccacggaacagcagatgataatgtgcactttcaaaactcagcacagattgctaaagctctggttaatgcacaagtggatttccaggcaatgtggtactctgaccagaaccacggcttatccggcctgtccacgaaccacttatacacccacatgacccacttcctaaagcagtgtttctctttgtcagactaaaaacgatgcagatgcaagcctgtatcagaatctgaaaaccttatataaacccctcagacagtttgcttattttattttttatgttgtaaaatgctagtataaacaaacaaattaatgttgttctaaaggctgttaaaaaaaagatgaggactcagaagttcaagctaaatattgtttacattttctggtactctgtgaaagaagagaaaagggagtcatgcattttgctttggacacagtgttttatcacctgttcatttgaagaaaaataataaagtcagaagttcaagtgcta

SEQ ID NO: 290 - DNA, 869 bp, Homo sapiens
ctgtacagggcaggttgtgcagctggaggcagagcagtcctctctggggagcctgaagcaaacatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgaggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcattccctaactctctgctgaatatggggttggtgttctcatctaatcaatacctacaagtcatcataattcagctcttgagagcattctgctcttctttagatggctgtaaatctattggccatctgggcttcacagcttgagttaaccttgcttttccgggaacaaaatgatgtcatgtcagctccgccccttgaacatgaccgtggccccaaatttgctattcccatgcattttgtttgtttcttcacttatcctgttctctgaagatgttttgtgaccaggtttgtgttttcttaaaataaaatgcagagacatgttttaagctga

SEQ ID NO: 291 - DNA, 1416 bp, Homo sapiens
agggacagcctgcgttcctgggctggctgggtgcagctctcttttcaggagagaaagctctcttggaggagctggaaaggtgcccgactccagccatgctggcgctactgtgttcctgcctgctcctggcagccggtgcctcggacgcctggacgggcgaggactcggcggagcccaactctgactcggcggagtggatccgagacatgtacgccaaggtcacggagatctggcaggaggtcatgcagcggcgggacgacgacggcgcgctccacgccgcctgccaggtgcagccgtcggccacgctggacgccgcgcagccccgggtgaccggcgtcgtcctcttccggcagcttgcgccccgcgccaagctcgacgccttcttcgccctggagggcttcccgaccgagccgaacagctccagccgcgccatccacgtgcaccagttcggggacctgagccagggctgcgagtccaccgggccccactacaacccgctggccgtgccgcacccgcagcacccgggcgacttcggcaacttcgcggtccgcgacggcagcctctggaggtaccgcgccggcctggccgcctcgctcgcgggcccgcactccatcgtgggccgggccgtggtcgtccacgctggcgaggacgacctgggccgcggcggcaaccaggccagcgtggagaacgggaacgcgggccggcggctggcctgctgcgtggtgggcgtgtgcgggcccgggctctgggagcgccaggcgcgggagcactcagagcgcaagaagcggcggcgcgagagcgagtgcaaggccgcctgagcgcggcccccacccggcggcggccagggacccccgaggcccccctctgcctttgagcttctcctctgctccaacagacaccctccactctgaggtctcaccttcgcctttgctgaagtctccccgcagccctctccacccagaggtctccctataccgagacccaccatccttccatcctgaggaccgccccaaccctcggagccccccactcagtaggtctgaaggcctccatttgtaccgaaacaccccgctcacgctgacagcctcctaggctccctgaggtacctttccacccagaccctccttccccaccccataagccctgagactcccgcctttgacctgacgatcttcccccttcccgccttcaggttcctcctaggcgctcagaggccgctctggggggttgcctcgagtccccccacccctccccacccaccaccgctcccgcgggaagccagcccgtgcaacggaagccaggccaactgccccgcgtcttcagctgtttcgcatccaccgccaccccactgagagctgctcctttgggggaatgtttggcaacctttgtgttacagattaaaaattcagcaattca

SEQ ID NO: 292 - DNA, 3539 bp, Homo sapiens
ctccgtccccacccgcccgccgtcccgccggcccgagccgtggcgcccagagctgcgagccgctcgcccctccgccgctccggcccgggccgccatgtcgctgtggaagaaaaccgtctaccggagtctgtgcctggccctggccctgctcgtggccgtgacggtgttccaacgcagtctcacccctggtcagtttctgcaggagcctccgccacccaccctggagccacagaaggcccagaagccaaatggacagctggtgaaccccaacaacttctggaagaacccgaaagatgtggctgcgcccacgcccatggcctctcaggggccccaggcctgggacgtgaccaccactaactgctcagccaatatcaacttgacccaccagccctggttccaggtcctggagccgcagttccggcagtttctcttctaccgccactgccgctacttccccatgctgctgaaccacccggagaagtgcaggggcgatgtctacctgctggtggttgtcaagtcggtcatcacgcagcacgaccgccgcgaggccatccgccagacctggggccgcgagcggcagtccgcgggtgggggccgaggcgccgtgcgcaccctcttcctgctgggcacggcctccaagcaggaggagcgcacgcactaccagcagctgctggcctacgaagaccgcctctacggcgacatcctgcagtggggctttctcgacaccttcttcaacctgaccctcaaggagatccacttcctcaagtggctggacatctactgcccccacgtccccttcattttcaaaggcgacgatgacgtcttcgtcaaccccaccaacctgctagaatttctggctgaccggcagccacaggaaaacctgttcgtgggcgatgtcctgcagcacgctcggcccattcgcaggaaagacaacaaatactacatcccgggggccctgtacggcaaggccagctatccgccgtatgcaggcggcggtggcttcctcatggccggcagcctggcccggcgcctgcaccatgcctgcgacaccctggagctctacccgatcgacgacgtctttctgggcatgtgcctggaggtgctgggcgtgcagcccacggcccacgagggcttcaagactttcggcatctcccggaaccgcaacagccgcatgaacaaggagccgtgctttttccgcgccatgctcgtggtgcacaagctgctgccccctgagctgctcgccatgtgggggctggtgcacagcaatctcacctgctcccgcaagctccaggtgctctgaccccagccgggctactaggacaggccagggcacttgctcctgagcccccatggtattggggctggagccacagtgcccaggcctagcctttggtccccaaggggaggtggagggttgaggcctacgtgccactgggtgtggtggggtgcaggtagccagaaagggacctccctgtgtggataattctaggaaactgaggcccaggaacggttggagctgcccagtctggaggccctctctgaggagcgaggcgccaggccctggcagccctcctgacctgggtccgttgctggccccctcagatgtggtgggaggtcctggtgacctctggaggaacgctgtgctcaggtacctgggctaggcctggcctgatgggtctgtggccgcccctcgtcttcacagggaagagtcttctgtgaaatgcctcagtctccccagaggccgggcggccctggcaggagaaactcaaccctgtgcgggctcacaggcaccccccagtccacaccctggtctcctgggagagagggcccagccggctctccgcagccccaggcctgcctggagacgggccgcctctgccacagggcctccactcctggctgtgtcctgtaaggtctggaagggcgaccgctctgactacctcagcgcccctcagaatctccctggggctgcagccctaccccaccccgacacagggcagaagagcagcgctcctggccccccgaagtcccagagctgctgacccccaccccaggcaagtctctcccgcagcccccacacccccaggcctggctccctggctggaaagcagccggtttggccctggaagtggacattcctctattactgtgaagttttatttatgaagaatttggagggagaaggctccaggcttcaggagggggtggtgtcctccctggccctcctcccttccctcccctcattccagctgcctgccctcagcacccccaggcccctcacagcccagccccctccagagccctgccccaccgcaccctgcttctccagggcctagcagaccagcatctgccccggtgaagggatggatcagctgtgggggtgggtgcagaaggttgccacctcctacctcagcgggagtcacctaggaaagatggagggattgacactattttctcaataaaatgggacttttttttttttttttttttttttttggtgtgaaacttcctgttcccagctgcatcagagagcctgtctggggccaaggttgccagagatttctgaagacacagcttgttccttgttcttggctggtgggtgcacaaggacttctggaagggatttagacggggctgagtgctaggattaaagtggggatgggagtacggcaacagaaaaacctgggagctagcaatgcacccagcccttgactgtgccctggtggacagccgagctgtggctctagcgtgagccagtgccttcctgtccctgccaagggtgaggccagagttggccccgaggctaatgtttcagtgggtgagattaggtcggccgtacagaggccggtgggctccctgacatcccttccaggcaacctgaaagcactgaaatagcttatggccctgtgccagggaccttggcccaagctgctgacctccagggtggggagggagctacccccaggagaagagtcactcagacagcagtatgagcaagccagccagcagctccgtgcctgcacccagctcaggggaatcccagggggttcagatgcccaggaaggaaaaggggacagcgctactgctatggaatgagaccaccacttctcctgttgtccttcccagcttctccccaacctccccttttccctagtttataagacaggagaaaagggagaaagcaaaaagctggaaagaaacagaagtaagataaatagctagacgaccttggcgccaccacctggccctggtggttaaaatgataataatattaacccctgaccaaaacgactggtgttatctgtaaatcccagacattgtgtgagaaagcaccgtaaaactttttgtcctattagctgatgtgtgtagcccccagtcacgttcctcacgcttacttgatctattatgaccctttcacgtggaccccttagagttgtaagctcttaaaagggctaggaatttctttttcggggagctcggctcttaagacgcgagtctgccgacgctcccggccgaataaaaacctcttccttctttaa

SEQ ID NO: 293 - DNA, 4691 bp, Homo sapiens
agacacgggcgaggggaggaagaaggcgcctcgggctccggtctcctgcgctcctgctgggcgccagcggctggaccttggcagccgtctgaggcttcggggagcccaaggccaccggcagcgcttgttagaatgcagattcccggggttcgactggaatgagaccccggggagcagcgtttgcagcgggcccgccaggtgacctgcacctgggcaccgccatcggcttcgcaggggccatctggaggagtcggtcacccgccatgtcgaccttgctggacattaagagcagcgtgctcaggcaggtgcaggtgtgcccgtccttccgccgcaggactgagcaggacccagggagtgccagcgccgacccgcaggagcctgccacgggggcctggaaacccggggatggcgtggagttctttgcccacatgcgcctcatgctgaagaagggggaaggcagacagggcttgccgtgcctcgaggtccccctgcgcagtggctcgccagcacccccggagcctgtggatcccagcctcggcctgagagccctggccccagaggaggtggagatgctctacgaggaggccctgtacacggtgctttaccgcgcgggtaccatgggccctgaccaggtggacgacgaggaggccctgctcagctatctccagcaggtgtttggcaccagccttgaggagcacactgaggccatcgagcgagtgaggaaggccaaggcccccacgtatgccctgaaagtctctgtcatgcgtgccaagaaccttctggccaaggaccccaacggcttcagcgacccatactgcatgctgggcatcctgcctgcctcggacgccacgcgggagccccgtgcacagaaggagcagcgcttcggcttccgcaagggcagcaagcgcggtggacccctgcctgccaagtgcatccaggtcaccgaggtgaagagcagcaccctgaaccccgtctggaaggagcacttcctcttcgagattgaggatgtgagcacggaccagctgcacctggacatctgggatcatgacgacgatgtatccctggtagaagcgtgcaggaagctgaatgaagtcatcggcctgaagggcatgggcaggtacttcaaacagatcgtcaagtcagcccgcgcaaacgggacagcaggacccaccgaggaccacaccgatgacttcctggggtgcctcaacatacctgtccgggaggtgcctgtggctggcgtcgaccgctggttcaagctggagccacgctccagtgcctcgcgtgtgcagggacactgccacctggttctcaagctgatcactacgcagagggatacggccatgagccagcgcgggcgatccggcttcctgtcccacctgctgctgctcagccatctgctgcggttggagcactcagcagaggagcccaactccagcagctggcgaggagagctcagcacaccagccgccaccatcctctgcctgcacggagcccagagcaacctgtcacccttgcagctggccgtgctgcactggcaggtcagcagccgccaccatcaaacctgcacgctggactacagctacctgctggggctgctggaggacatgcaggcacactgggaagaggctccttcactgccccaggagcaggaggagagcctggctgatagcctttccgccttctctgagttcgggctgcagctgctgcgccagctccgagactacttccctgccaccaacagcaccgctgtccaccgcctggagctgctgctgaagtgtctgggcaagctgcagctcttccaaccctcctttgagatctgccccttcgagtcggagctgaacatggacattgctgcggccctgaagagaggcaaccgtgagtggtacgacaggatcctgaatgacaagagtccccgagagcagccaggaccacagcgcctgcctgggctggttgtgctggctgacgccgtctatgatgaccttcagttctgctacagtgtgtacgccagcctcttccacagcatcctcaatgtggacgtcttcaccctgaccttccggcagctggagcgtctggtggctgaggaggcgtgggtgctgacggaggagctgagccccaagatgaccctggaggtggcctcggggctctttgagctctacctgaccctggctgacctccagcgcttctgggatagcatccctggccgggacagccgctctctggccctggctggcatccacgcccccttcctgcctgctgtgaagctctggttccaagtgctgagggaccaggccaagtggaggcttcagggagccgtggacatggacacgctggagcccgtggacgcctcctccaggcacagcagctccgcagccactgctggtctctgcctcagccacatccaggagttgtgggtgcgcctggcgtggcctgaccctgcccaggctcaggggctgggcacccagcttggccaggacgtgtgtgaggccaccctcttctatacggagctgcttcggaagaaggtggacactcagccaggggcggccggtgaagcagtgagcgaggcgctctgcgtggtcctcaacaatgtggagctcgtgcgcaaggctgctgggcaggccttgaagggcctggcatggccagagggggccacggggcccgagggggtgctcccccgccctctgctcagctgcacacaggccctggacgatgatctgcaacgggaggcccacacggtgacagcgcacctgacctctaagatggtgggcgacatccgcaagtatgtacagcacatcagtctctcgcctgactccatccagaacgatgaggccgtggccccgctcatgaagtacctggatgagaagctggccctgctgaacgcctcgctggtgaaggggaacctgagcagggtgctggaggccctgtgggagctactcctccaggccattctgcaggcgctgggtgcaaaccgtgacgtctctgctgatttctacagccgcttccatttcacgctggaggccctggtcagttttttccacgcagagggtcagggtttgcccctggagagcctgagggatggaagctacaagaggctgaaggaggagctgcggctgcacaaatgttccacccgcgagtgcatcgagcagttctacctggacaagctcaaacagaggaccctggagcagaaccggtttggacgcctgagcgtccgttgccattacgaggcggctgagcagcggctggccgtggaggtgctgcacgccgcggacctgctccccctggacgccaacggcttaagtgacccctttgtgatcgtggagctgggcccaccgcatctctttccactggtccgcagccagaggacccaggtgaagacccggacgctgcaccctgtatacgacgaactcttctacttttccgtgcctgccgaggcgtgccgccgccgcgcggcctgtgtgttgttcaccgtcatggaccacgactggctgtccaccaacgacttcgctggggaggcggccctcggcctaggtggcgtcactggtgtcgcccggccccaggtgggcgggggtgcaagggctgggcagcctgtcaccctgcacctgtgccggcccagagcccaggtgagatctgcgctgaggaggctggaaggccgcaccagcaaggaggcgcaggagttcgtgaagaaactcaaggagctggagaagtgcatggaggcggacccctgagtccatcagctgccagccccggccctggcccccaccccaagttccctgaagcatcctccagctcactgtggccagctttgtgcaaccagggcccacggcgcccctcctgtgctgtgacgtgtgtgtcgtggctggccccgcggcgcctaccgccctggccgtgtctgtctggtgtgtgctgtgaacccctgcacccaaccccacatctgggtggccaacttggcaggacttggccagcagctgcccaggacacagtgcaggccagagcgggcttgaccacctggtgggcctccctgcccgcttccttgggctccccggccctgggtgggcggtgggcagctggtctccagggactcagtgagtggctgtgctctctgcacaacgggcaatgtgcagacgcatttttggtaatcacagctggggagtgaaaagggtgccactggcaccactgggtggatggtccagagcctccacccacagaggggatgcaaagggcaggtgagtcaagaaccgcataggtctccagtccccacggggctcccaggccggggaaaggttcccctgaggtcactctgaggccagggacgtcacccaaggctggtggtcagtgtgaagggctccgtgccaactggtcagctgtccttcacgcacatatccgtggccacctgagacctgctccacgacccttccaggcagagccgagagttcgccccaacccttccccaggcccagtgtgaaaaacagactcacaaggggcttcttggcctgcagcttcatttgcgagagcgccgaggcaggacacagagcacagctgtgctggaagtgtggggagaacccggacagctcagtcctgccagcagccgcaaagagccgaggctgccaggcccatttatgtccctcatgtctctagattttctcgtcacccagcctcaaaaatatatgtgtctgcaaccctcagtaaaaaaaaaa

SEQ ID NO: 294 - DNA, 2883 bp, Homo sapiens
acagaagtgctagaagccagtgctcgtgaactaaggagaaaaagaacagacaagggaacagcctggacatggcatcagagatccacatgacaggcccaatgtgcctcattgagaacactaatgggcgactgatggcgaatccagaagctctgaagatcctttctgccattacacagcctatggtggtggtggcaattgtgggcctctaccgcacaggcaaatcctacctgatgaacaagctggctggaaagaaaaagggcttctctctgggctccacggtgcagtctcacactaaaggaatctggatgtggtgtgtgccccaccccaagaagccaggccacatcctagttctgctggacaccgagggtctgggagatgtagagaagggtgacaaccagaatgactcctggatcttcgccctggccgtcctcctgagcagcaccttcgtgtacaatagcataggaaccatcaaccagcaggctatggaccaactgtactatgtgacagagctgacacatagaatccgatcaaaatcctcacctgatgagaatgagaatgaggttgaggattcagctgactttgtgagcttcttcccagactttgtgtggacactgagagatttctccctggacttggaagcagatggacaacccctcacaccagatgagtacctgacatactccctgaagctgaagaaaggtaccagtcaaaaagatgaaacttttaacctgcccagactctgtatccggaaattcttcccaaagaaaaaatgctttgtctttgatcggcccgttcaccgcaggaagcttgcccagctcgagaaactacaagatgaagagctggaccccgaatttgtgcaacaagtagcagacttctgttcctacatctttagtaattccaaaactaaaactctttcaggaggcatccaggtcaacgggcctcgtctagagagcctggtgctgacctacgtcaatgccatcagcagtggggatctgccgtgcatggagaacgcagtcctggccttggcccagatagagaactcagctgcagtgcaaaaggctattgcccactatgaacagcagatgggccagaaggtgcagctgcccacagaaaccctccaggagctgctggacctgcacagggacagtgagagagaggccattgaagtcttcatcaggagttccttcaaagatgtggaccatctatttcaaaaggagttagcggcccagctagaaaaaaagcgggatgacttttgtaaacagaatcaggaagcatcatcagatcgttgctcagctttacttcaggtcattttcagtcctctagaagaagaagtgaaggcgggaatttattcgaaaccagggggctatcgtctctttgttcagaagctacaagacctgaagaaaaagtactatgaggaaccgaggaaggggatacaggctgaagagattctgcagacatacttgaaatccaaggagtctatgactgatgcaattctccagacagaccagactctcacagaaaaagaaaaggagattgaagtggaacgtgtgaaagctgagtctgcacaggcttcagcaaaaatgttgcaggaaatgcaaagaaagaatgagcagatgatggaacagaaggagaggagttatcaggaacacttgaaacaactgactgagaagatggagaacgacagggtccagttgctgaaagagcaagagaggaccctcgctcttaaacttcaggaacaggagcaactactaaaagagggatttcaaaaagaaagcagaataatgaaaaatgagatacaggatctccagacgaaaatgagacgacgaaaggcatgtaccataagctaaagaccagagccttcctgtcacccctaaccaaggcataattgaaacaattttagaatttggaacaagcgtcactacatttgataataattagatcttgcatcataacaccaaaagtttataaaggcatgtggtacaatgatcaaaatcatgttttttcttaaaaaaaaaaaaagactgtaaattgtgcaacaaagatgcatttacctctgtatcaactcaggaaatctcataagctggtaccactcaggagaagtttattcttccagatgaccagcagtagacaaatggatactgagcagagtcttaggtaaaagtcttgggaaatatttgggcattggtctggccaagtctacaatgtcccaatatcaaggacaaccaccctagcttcttagtgaagacaatgtacagttatccgttagatcaagactacacggtctatgagcaataatgtgatttctggacattgcccatgtataatcctcactgatgatttcaagctaaagcaaaccaccttatacagagatctagaatctctttatgttctccagaggaaggtggaagaaaccatgggcaggagtaggaattgagtgataaacaattgggctaatgaagaaaacttctcttattgttcagttcatccagattataacttcaatgggacactttagaccattagacaattgacactggattaaacaaattcacataatgccaaatacacaatgtatttatagcaacgtataatttgcaaagatggactttaaaagatgctgtgtaactaaactgaaataattcaattacttattatttagaatgttaaagcttatgatagtcttttctaactcttaacactcatacttgaaaactttctgagtttccccagaagagaatatgggattttttttgacatttttgactcatttaataatgctcttgtgtttacctagtatatgtagactttgtcttatgtgtgaaaagtcctaggaaagtggttgatgtttcttatagcaattaaaaattatttttgaactgaaaa

SEQ ID NO: 295 - DNA, 5344 bp, Homo sapiens
cttttgtaatcacaacatgatctcgtgtgctgagcagcgaagccggcagggagaggccggcagaggcccggctccggtggctccagctttcctcccactctggctccccaggggctgctctggaattctctcggtgcccgccgttgccatgcactcggctggaactcccagagccgagtcccccatgagcaggcaggagaaggacgcagagctggatcggaggatagttgccctgcgcaagaagaaccaggccttgctccgcaggtaccaggagatccaggaggaccgtcggcaggcagagcagggggggatggctgtgaccacaccagcactcctccagcctgatggcctcaccgttaccatcagccaggttcccggtgaaaagcgggtggttagcaggaactgggcaaggggtacctgtggacccagagtgaccaacgagatgcttgaggatgaggatgctgaggaccacgggggtactttctgcttaggggagctggtggagctggctgtgaccatggagaacaaagcagagggcaaacggattgtaagtgaaaagcctaccagagcaaggaaccaaggcatagaggggtcacctggagggcgtgtgacccgaagcccccccacgcaggtggccatcagctcagattctgcacggaagggttcttgggagccctggagccggccggtgggggagcccccggaggcgggctgggactatgcccagtggaagcaggagcgggagcagatcgacctagcccgcctcgcccggcacagagacgcacagggtgactggcgccgcccgtgggacctggacaaggccaagtccacgctacaggactgcagccagctgaggggagaaggcccggccagggcaggcagcagaaggggtcccaggagccaccagaaactacagcccccaccattgctccctgatggaaaaggtcggggcgggcaagccagcagaccctcggtggcaccagccacaggcagcaaagcccggggcaaggagaggctgactggcagggcccgaaggtgggatatgaaggaagacaaggaggagctggaaggtcaggagggaagccaaagcaccagagagactcccagtgaggaggagcaagcccagaagcagagcgggatggagcagggccgactggggagcgcccctgcagccagcccagccctggcatccccagaggggccgaagggggagtcagtggcttccacagccagctcagtcccctgctctccacaggagcctgacttggctcctcttgacctctccctaggaggggctggcatccctgggcccagggagagcgggtgtgtgctcggtctgaggcctggggcccaggagagccctgtgtcttggccagagggctctaagcagcagcccctggggtggagcaatcaccaggctgagctggaagtacagacttgccctgagccacagagaggagcagggctcccagagcccggagaagacaggtctggcaagtctggggcccagcagggcctggccccgagaagccggcccacgagaggaggcagccaaaggtcgagaggcacagcaggtgtgaggcgcaggacagggcgccctggcccggcaggaagatgctgaacacagctcctgggagctggggagtccccggggagaggaaaagggaatcactctgttaaaggccctccgcgtgatggccatgtggttgccggtggcttgcgccattgtcactgagcagtgtggcaaactctccagcatggcgaccttgtgagggcaaggagtggcctccctgcacctcacacgctcatctctgtgcacatgtgtgttttcacgcacgggcacagcccctggtgtattcctgtactagtatctggcatctgaggctggtgcaccctgacctgggcctactgctgcccaggccacaagccttctccactatgatgagagaacaaggcttggtggcacccagcacctggctctcctggctccccgtcacccccccagggcctggcctccctctccagctgcaggctttcacctcttgcctgggctggattcccccagtcccagattcccaggatgcccaaccaggggaatcccagtaaccatgcgccagcctcctgcctctcctgagtggtggctgaggcctggaggaggagaggccacacagctggcagggtctggcctgggcaaagaagagtagagctcacgtcttcttggtgaaaaggaggatctctggaaagtcctcctctctgaaatgggttgggatggggagcgacaacctcctcttcccacagcaggatgggagagcttactcccaggcccccacacccaggtcagacatcacgtgcaccctgaatgtaggcaagggcctggccctgcagcccagggtcatttcctgctctttccacttcctctttccccaccgtcctgcactagcaccagggccaggccaaggcaagaatcagacagctactccacagacagagaaacaacttccagctaagtatgacatcaggacttgtctttcctactaagcctccatccccgcccctcccctgaggcccacgtctgctgaattatccggactccgcacaagctgtggcttcctctcagttcaacaaacatttcctgagcacccactaccagtaatccagccggtaggcgacggagactgccagcaggagggagggaagaaagccagtcatccggcagatctgggctgttctgggcgggagctgttctgggccacaggtgccctacagggctgggggcaggatggcggtaggagccccaggggaccctcccacctctgcctggcagaagcaagtgcccttctttcttgttatgtgtgccttctgctcctgagccctagtgtggacctcaccgcatggtcccctctgccccctccttctggtcctgccatggctgctgctctctgctgaaggctgtggggctctagggagagtccagatcaccctgggatttctccactgcccaatgtgaagcctaaactgtggggtcccagctcagccttcctcactggctctcaactccaccccacccctctattcaggaaggtgaggggcatctctttagcagaccagactgttttgagaagtgtctctcatactttaactgaagagtcatgcagattctaatggtctggggagggcctgagagttcgtcttttttttttttttttttttttagttagggtcctgctgttatcacctaggctggagtgcagtggcacaatcatggctcactgcagcctcgaaccctccaggctcaggcgatcctctcacatcaacctcttgagtagccgggactacaggtgtgccaccacacctggctaatttttgtattttttgtagaggcagggtttcaccatgttgcccaggctggtctccaactcctgggctcaagcaatctgctcgccttggcctcctaaactgctgggattacaggcatgagccaccacacctggccgagaattcgtatttctaagaggcttcaggtgaagcccatgctggttcctggaccatggttttgagtagttaagggtttggactagaatatatgaagggctgggggtgaagacagactctagactctaaaggttggtggctggctatgtaggggatgggggagtgctacccctgtcaggtggtgggggcttcctggctgcagagttgggtgggagacttggggaagatgctttggaaggcagtgagtgggtggtgtcaacttctagtagtgcagtgggagagctggtcagggatgggatggagtgaagggggcagaggcatttggtgtggggttgatcagaggaattttggaaaggcttggaaacattcctatgtatgtgagacacacctatgccagggcaaagactccaagctcaagtttttctcttgccttctagtcacaagaacatggctttggagtgtgacactggcctaggaatccatgactcccaaaggacggggctaggggtagaggaggttcaggcaaagcccttagattttggagacatcaggcagatgtctccaaaaatgattgtgatcaagaatctgaattataagattcacagtctgctccccaacccagtgctgccaactgtacagctgcgcctccacgaaggggcatatgccaggctcgtctgaccctggaatgaggatgtaggaagcaggcagagctcgggttcagccctcacaatgggactgaagcaggagagaaggctgggcagaagggctgtggggaagtagggcttgtctccatggatgacgtccagaaggatgtcaggaggaggaatatcacaggagttatagacattggagggaacagagactggcacaggacctcttcattgcaggaagatggtagtgtaggcaggtaacattgagctcttttcaaaaaaggagagctcttcttcaagataaggaagtggtagttatggtggtaacccccggctatcagtccggatggttgccacccctcctgctgtaggatggaagcagccatggagtgggagggaggcgcaataagacacccctccacagagcttggcatcatgggaagctggttctacctcttcctggctcctttgtttaaaggcctggctgggagccttccttttgggtgtctttctcttctccaaccaacagaaaagactgctcttcaaaggtggagggtcttcatgaaacacagctgccaggagcccaggcacagggctgggggcctggaaaaaggagggcacacaggaggagggaggagctggtagggagatgctggctttacctaaggtctcgaaacaaggagggcagaataggcagaggcctctccgtcccaggcccatttttgacagatggcgggacggaaatgcaatagaccagcctgcaagaaagacatgtgttttgatgacaggcagtgtggccgggtggaacaagcacaggccttggaatccaatggactgaatcagaaccctaggcctgccatctgtcagccgggtgacctgggtcaattttagcctctaaaagcctcagtctccttatctgcaaaatgaggcttgtgatacctgttttgaagggttgctgagaaaattaaagataagggtatccaaaatagtctacggccataccaccctgaacgtgcctaatctcgtaagctaagcagggtcaggcctggttagtacctggatggggagagtatggaaaacatacctgcccgcagttggagttggactctgtcttaacagtagcgtggcacacagaaggcactcagtaaatacttgttgaataaatgaagtagcgatttggtgtgaaaaaaaaaaaaaaaaaa

SEQ ID NO: 296 - DNA, 5501 bp, Homo sapiens
agtggcagggtgggggccaggcagcacagatgaagcatttacctatctaggtaagtcaggaggagctcaaaaggagaagaaaacagtaggaggcaggggaagcagcctctgtctccatctctgccctttgaaacaaaagggtatttcttttctctcttcagcccccaacccagtggaggcccggcttgggacattgttcacttcccctcgcttcccctctagaagccccctttgccatccctgcaccttgtttcgggtgatgcccgagagggagctgtggccagcggggactggctcagaacccgtgacccgtgtcggcagctgtgacagcatgatgagcagcacctccacccgctctggatctagtgatagcagctacgacttcctgtccactgaagagaaggagtgtctgctcttcctggaggagaccattggctcactggacacggaggctgacagcggactgtccactgacgagtctgagccagccacaactcccagaggtttccgagcactgcccataacccaacccactccccggggaggtccagaggagaccatcactcagcaaggacgaacgccaaggacagtaactgagtccagctcatcccaccctcctgagccccagggcctaggcctcaggtctggctcctacagcctccctaggaatatccacattgccagaagccagaacttcaggaaaagcaccacccaggctagcagtcacaaccctggagaaccggggaggcttgcgccagagcctgagaaagaacaggtcagccagagcagccaacccaggcaggcacctgccagcccccaggaggctgcccttgacttggacgtggtgctcatccctccgccagaagctttccgggacacccagccagagcagtgtagggaagccagcctgcccgaggggccaggacagcagggccacacaccccagctccacacaccatccagctcccaggaaagagagcagactccttcagaagccatgtcccaaaaagccaaggaaacagtctcaaccaggtacacacaaccccagcctcctcctgcagggttgcctcagaatgcaagagctgaagatgctcccctctcatcaggggaggacccaaacagccgactagctcccctcacaacccctaagccccggaagctgccacctaatattgttctgaagagcagccgaagcagtttccacagtgacccccagcactggctgtcccgccacactgaggctgcccctggagattctggcctgatctcctgttcactgcaagagcagagaaaagcacgtaaagaagctctagagaagctggggctaccccaggatcaagatgagcctggactccacttaagtaagcccaccagctccatcagacccaaggagacacgggcccagcatctgtccccagctccaggtctggctcagcctgcagctccagcccaggcctcagcagctattcctgctgctgggaaggctctggctcaagctccggctccagctccaggtccagctcagggacctttgccaatgaagtctccagctccaggcaatgttgcagctagcaaatctatgccaatttctatccctaaggccccaagggcaaacagtgccctgactccaccgaagccagagtcagggctgactctccaggagagcaacacccctggcctgagacagatgaacttcaagtccaacactctggagcgctcaggcgtgggactgagcagctacctttcaactgagaaagatgccagccccaaaaccagcacttctctgggaaagggctccttcttggacaagatctcgcccagtgtcttacgtaattctcggccccgcccggcctccctgggcacggggaaagattttgcaggtatccaggtaggcaagctggctgacctggagcaggagcagagctccaagcgcctgtcctaccaaggacagagccgtgacaagcttcctcgccccccctgtgtcagtgtcaagatctccccaaagggtgtccccaatgaacacagaagggaggccctgaagaagctgggactgttgaaggagtagactctgcgaccagtacagaccctgtcctggctgaacaagaagagacacatgctccacttgggagcctttgccaccacgcaactcagggctcaagatgaatgggagggagagatttgagtccaagcatacatttatattcagtgttgtgccattgagttcccatgtggatcattctgaaggtgatctccacaagagggtgtgtgtgtgtgtgtttggtgtgtgtgtggagggggggccgctggatacatcactgaagctattgatataacacaatgagtcactgttcagaattttgctcttgttagatgttttcttacattgggtagagtccagcctagtgagagctgagtgaaggggctggccatgcctgagacaaaaagtcaaatgagacaatggacgtgtcaatgacttgaaaaaaagtcacatccagcaaatgcagggtcacatgaaatatgggcctcctggaatccctacagtggatggagactggctcataccttgccagatccctctctcagttccagccttctggacaaggcctgggctaagaggagctgattcgttatctcttcacccactgccctctcagtatcaccagtcccaaagacaggatacgtccctgtaacccaatctctcggttgattgatagcagaacagctcttgttggtctgagaaggcaggataagtgaccacatatttatgccactacctccaccagggagagtccttctccacaggcttgataaattcaatcaccaactgtgctgtcgtccctgactctgctactcccgttcttcctgctttcctgctccgtatctcagtctgcactgaccccagggctgggctgacatcaagatgggagcccagcccacgggctttataaacacccaagaaccgtttcagatcttctctgtgctgatgcaggtagttttaaatttttctcagttccagtgatagaaaacccacacaatacatcctctgccagtcttaatagaatatcagaggtaagaggggcctcagagaagctctgacgcagtgctgctggggaagggaagtgactaaccccgggtcagcctgccatttagggaaagagctgaggttcttacccttgttgcatgctgccacctctccttagccagtgctcttgtacatccacacagcaccctaaggagccatagtcaccatcaaagactcaaccctaaggcccttcaagatctcaaagtgccttctgaagcatcagagattaaatattgttcaaactaatagttattgctgtggcttttaattttatctttggaagatagctatatggtaactcatcattaaccagaacacctctcccctcaaattccgtgaccaagttgtgcagcttgagcaaatgccgaaagagggtattatgggtgggtggtgtgggcttgcaaatacaagcttggaggtgagacatggccagacatgactcctgcttccccttaggaagtaaatcttacttatggttgtgaactgcttggagtccaggatgcccagatgtgaggggcagatgaagggaatgttgctggaaaggtgccttttaaggctgctgagaatttctggactgtgtcctgatggacgcagcaccatcaaagcccagaatttctgaaaacggtgacaaggttaacataaggacaacaaatactccaccctgtcatggtatgtgaggtgtgggtgtggcggtttctgtgtacgtttgctcatacacgcacatccaaaagcctgtgcctcattcctggccatgggtgaggacttggtctgtcacggctgatgaggactcccacaaccggccaagttatgtcttattatacacccccagaaagagagaaagctgccttctggaggactgattccacatgctatattcagctgagttgatttctgtgtctatttcaacccataacctgaagaatgatcaccttattccttattcattaattttcttgattaatagggaaacttgggaatagctataaagtaaaacttgggtggaacctggggccctggcatcacacaagtgtgattaggatggtcaaggtcatcaggagtacagcctattatattcccacatcctgagaaaggtcatttctcccacacacgacaaagtcacagacatcctgcacctgccactaggcatcctcatcctactgacatgcccatttctccagttttcttaatctgagactcccttcccttgttttttaaagataccgtgcttctccacatcctcatccttcaaggagcatattttgctcttaggatggtctttgggattcaagaatagaataataaatccaaacttggtcattcccattttgaagagatgcaagagggcccagtgaggacatccgcctccctgaaagtggtgctagacagagctgaggtcattgtatctgtgtatccacataggatttctcttaattcagcttgaattgatggggagggaggtaagagtagggtcagagttactcatcccttttcaaagaattgtgggtggaagtttgtaaaggccattcatttgattttcaaaatcaaagcgacagctctacttccacttggccttagatctctgctataccctgccatagccttgatgccactgggcacaagccacctgccaaatacaggagtggcctctcccagcctggcatgataggggggtctgtgccctcagatgtgttgacagctgctcttctgaattgccacacctgtgctacacttggaattctgtgctctgactctgcagggtaggaccacgtgccatctcacacagaggtcaaccgatgagcccactcactcgtacatgccttcttccacagtgggaagcatgatctggcaggggccgccctgtaggctggggatgggctgctgtgtgaatgttgacgttcgtttcatggagaaaggggaggtgaaagattgaagagcaggttcctgtcaatgttctgagttcgagctggaggtgtagattgaatagtctacatggtctgtgagtgtgtgagatgaacccttccatcctttgacacctggttgtatgtgtaggctaagaaggaaggaccctcctgtcagtgtgcaaagctgtaatctcatggactagaggagagggggccaaggggatggacaggagaagtcatgcagaatctaagcaggaatgcagatagaacacatctaggctcttttccccaggagagtgatgatggagcatatagatctggctcaaattcagcctccatcacttaccagtcaggaaccctggcgatatcactttaactttctgaacctcagagtcttcacctataagacggggaaaataataccaccctttcaagattgttgagataaataagtgatataaaacatgtaaagcttagttctggccacagtgtagctactcaataaatgataatactac

SEQ ID NO: 297 - DNA, 4612 bp, Homo sapiens
gcgcagcagacctgctccggccgcgcgcctcgccgctgtcctccgggagcggcagcagtagcccgggcggcgagggctgggggttcctcgagactctcagaggggcgcctcccatcggcgcccaccaccccaacctgttcctcgcgcgccactgcgctgcgccccaggacccgctgcccaacatggattttctcctggcgctggtgctggtatcctcgctctacctgcaggcggccgccgagttcgacgggaggtggcccaggcaaatagtgtcatcgattggcctatgtcgttatggtgggaggattgactgctgctggggctgggctcgccagtcttggggacagtgtcagcctttctacgtcttaaggcagagaatagccaggataaggtgccagctcaaagctgtgtgccaaccacgatgcaaacatggtgaatgtatcgggccaaacaagtgcaagtgtcatcctggttatgctggaaaaacctgtaatcaagatctaaatgagtgtggcctgaagccccggccctgtaagcacaggtgcatgaacacttacggcagctacaagtgctactgtctcaacggatatatgctcatgccggatggttcctgctcaagtgccctgacctgctccatggcaaactgtcagtatggctgtgatgttgttaaaggacaaatacggtgccagtgcccatcccctggcctgcagctggctcctgatgggaggacctgtgtagatgttgatgaatgtgctacaggaagagcctcctgccctagatttaggcaatgtgtcaacacttttgggagctacatctgcaagtgtcataaaggcttcgatctcatgtatattggaggcaaatatcaatgtcatgacatagacgaatgctcacttggtcagtatcagtgcagcagctttgctcgatgttataacatacgtgggtcctacaagtgcaaatgtaaagaaggataccagggtgatggactgacttgtgtgtatatcccaaaagttatgattgaaccttcaggtccaattcatgtaccaaagggaaatggtaccattttaaagggtgacacaggaaataataattggattcctgatgttggaagtacttggtggcctccgaagacaccatatattcctcctatcattaccaacaggcctacttctaagccaacaacaagacctacaccaaagccaacaccaattcctactccaccaccaccaccacccctgccaacagagctcagaacacctctaccacctacaaccccagaaaggccaaccaccggactgacaactatagcaccagctgccagtacacctccaggagggattacagttgacaacagggtacagacagaccctcagaaacccagaggagatgtgttcattccacggcaaccttcaaatgacttgtttgaaatatttgaaatagaaagaggagtcagtgcagacgatgaagcaaaggatgatccaggtgttctggtacacagttgtaattttgaccatggactttgtggatggatcagggagaaagacaatgacttgcactgggaaccaatcagggacccagcaggtggacaatatctgacagtgtcggcagccaaagccccagggggaaaagctgcacgcttggtgctacctctcggccgcctcatgcattcaggggacctgtgcctgtcattcaggcacaaggtgacggggctgcactctggcacactccaggtgtttgtgagaaaacacggtgcccacggagcagccctgtggggaagaaatggtggccatggctggaggcaaacacagatcaccttgcgaggggctgacatcaagagcgtcgtcttcaaaggtgaaaaaaggcgtggtcacactggggagattggattagatgatgtgagcttgaaaaaaggccactgctctgaagaacgctaacaactccagaactaacaatgaactcctatgttgctctatcctctttttccaattctcatcttctctcctcttctcccttttatcaggcctaggagaagagtgggtcagtgggtcagaaggaagtctatttggtgacccaggtttttctggcctgcttttgtgcaatcccaatgaacagtgataccctccttgaaatacaggggcatcgcagacacatcaaagccatctgtgggtgttgccttccatcctgtgtctctttcaggaaggcattcagcatgcgtgagccataccatcctccatcctgattacaaggtgctccttgtagcaaattatgagagtgagttacgggagcagtttttaaaagaaatctttgcagatggctatgatgttatgtgttcggtgttgtaccatgagtagtattgacttcccttgagatatgatgtacaatgtgcttgtgaaattgacttaccctcttcacttaagttagttctggcctgacctgaactctgacttttactgccattcactttataaaataagggtgtgtaacatatcaagatacatttatttttatctgttttttttttcctgttaaagacaattatgtagagtgggcacgtaatccctccttagtagtattgtgttttgtgtaaatgtgctattgatattaagtatttacatgttccaaatatttacagactctagttgcaaggtaaagggcagcttgtgatctcaaaaaaatacatggtgaaatgtcatccagttccatgaccttatattggcagcagtaggaaattggcagaagtgttgggttgtggtaacggagtgatgaatttttttttaatggccttgagtttgatctctgcaaaggataggaaacctttaggaagacaagaaactgcagttaatttagaactgtcactgtttcaagttacactttaaaaccacagcttttaccatcataacatggctctggtaatatgtaggaagctttataaaagttttggttgattcagaaaaaggatcctgttgcagagtgagaggaagcatagggggaaactccattggaacagattttcacacaacgttttaaattgatataagtttaggcagttgtagttcataacttatgttgctcatgttgtgctgtgtcaggatgggataggaagcaagtcccatgcttagaggcatgggatgtgttggaacgggatttacacacactggaggagcagggcaagttggaattctaagatccatgaacccccaactgtatttcctccctgcatattttaccaatatattaaaaaacaatgtaacttttaaaaggcatcattcctgaggtttgtcttaatttctgattaagtaatcagaatattttctgctatttttgccaggaatcacaaagatgattaaagggttggaaaaaaagatctatgatggaaaattaaaggaactgggattattgagcctggagaagagaagactgaggggcaaaccattgatggttttcaagtatatgaagggttggcacagagagggtggcgaccagctgttctccatatgcactaagaatagaacaagaggaaactggcttagactagagtataagggagcatttcttggcaggggccattgttagaatacttcataaaaaaagaagtgtgaaaatctcagtatctctctctctttctaaaaaattagataaaaatttgtctatttaagatggttaaagatgttcttacccaaggaaaagtaacaaattatagaatttcccaaaagatgttttgatcctactagtagtatgcagtgaaaatctttagaactaaataatttggacaaggcttaatttaggcatttccctcttgacctcctaatggagagggattgaaaggggaagagcccaccaaatgctgagctcactgaaatatctctcccttatggcaatcctagcagtattaaagaaaaaaggaaactatttattccaaatgagagtatgatggacagatattttagtatctcagtaatgtcctagtgtggcggtggttttcaatgtttcttcatgttaaaggtataagcctttcatttgttcaatggatgatgtttcagatttttttttttttaagagatccttcaaggaacacagttcagagagattttcatcgggtgcattctctctgcttcgtgtgtgacaagttatcttggctgctgagaaagagtgccctgccccacaccggcagacctttccttcacctcatcagtatgattcagtttctcttatcaattggactctcccaggttccacagaacagtaatattttttgaacaataggtacaatagaaggtcttctgtcatttaacctggtaaaggcagggctggagggggaaaataaatcattaagcctttgagtaacggcagaatatatggctgtagatccatttttaatggttcatttcctttatggtcatataactgcacagctgaagatgaaaggggaaaataaatgaaaattttacttttcgatgccaatgatacattgcactaaactgatggaagaagttatccaaagtactgtataacatcttgtttattatttaatgttttctaaaataaaaaatgttagtggttttccaaatggcctaataaaaacaattatttgtaaataaaaacactgttagtaata

SEQ ID NO: 298 - DNA, 2712 bp, Homo sapiens
ctcacttccctggagccgcccgcttgcccgtcggtcgctagctcgctcggtgcgcgtcgtcccgctccatggcgctcttcgtgcggctgctggctctcgccctggctctggccctgggccccgccgcgaccctggcgggtcccgccaagtcgccctaccagctggtgctgcagcacagcaggctccggggccgccagcacggccccaacgtgtgtgctgtgcagaaggttattggcactaataggaagtacttcaccaactgcaagcagtggtaccaaaggaaaatctgtggcaaatcaacagtcatcagctacgagtgctgtcctggatatgaaaaggtccctggggagaagggctgtccagcagccctaccactctcaaacctttacgagaccctgggagtcgttggatccaccaccactcagctgtacacggaccgcacggagaagctgaggcctgagatggaggggcccggcagcttcaccatcttcgcccctagcaacgaggcctgggcctccttgccagctgaagtgctggactccctggtcagcaatgtcaacattgagctgctcaatgccctccgctaccatatggtgggcaggcgagtcctgactgatgagctgaaacacggcatgaccctcacctctatgtaccagaattccaacatccagatccaccactatcctaatgggattgtaactgtgaactgtgcccggctgctgaaagccgaccaccatgcaaccaacggggtggtgcacctcatcgataaggtcatctccaccatcaccaacaacatccagcagatcattgagatcgaggacacctttgagacccttcgggctgctgtggctgcatcagggctcaacacgatgcttgaaggtaacggccagtacacgcttttggccccgaccaatgaggccttcgagaagatccctagtgagactttgaaccgtatcctgggcgacccagaagccctgagagacctgctgaacaaccacatcttgaagtcagctatgtgtgctgaagccatcgttgcggggctgtctgtagagaccctggagggcacgacactggaggtgggctgcagcggggacatgctcactatcaacgggaaggcgatcatctccaataaagacatcctagccaccaacggggtgatccactacattgatgagctactcatcccagactcagccaagacactatttgaattggctgcagagtctgatgtgtccacagccattgaccttttcagacaagccggcctcggcaatcatctctctggaagtgagcggttgaccctcctggctcccctgaattctgtattcaaagatggaacccctccaattgatgcccatacaaggaatttgcttcggaaccacataattaaagaccagctggcctctaagtatctgtaccatggacagaccctggaaactctgggcggcaaaaaactgagagtttttgtttatcgtaatagcctctgcattgagaacagctgcatcgcggcccacgacaagagggggaggtacgggaccctgttcacgatggaccgggtgctgacccccccaatggggactgtcatggatgtcctgaagggagacaatcgctttagcatgctggtagctgccatccagtctgcaggactgacggagaccctcaaccgggaaggagtctacacagtctttgctcccacaaatgaagccttccgagccctgccaccaagagaacggagcagactcttgggagatgccaaggaacttgccaacatcctgaaataccacattggtgatgaaatcctggttagcggaggcatcggggccctggtgcggctaaagtctctccaaggtgacaagctggaagtcagcttgaaaaacaatgtggtgagtgtcaacaaggagcctgttgccgagcctgacatcatggccacaaatggcgtggtccatgtcatcaccaatgttctgcagcctccagccaacagacctcaggaaagaggggatgaacttgcagactctgcgcttgagatcttcaaacaagcatcagcgttttccagggcttcccagaggtctgtgcgactagcccctgtctatcaaaagttattagagaggatgaagcattagcttgaagcactacaggaggaatgcaccacggcagctctccgccaatttctctcagatttccacagagactgtttgaatgttttcaaaaccaagtatcacactttaatgtacatgggccgcaccataatgagatgtgagccttgtgcatgtgggggaggagggagagagatgtactttttaaatcatgttccccctaaacatggctgttaacccactgcatgcagaaacttggatgtcactgcctgacattcacttccagagaggacctatcccaaatgtggaattgactgcctatgccaagtccctggaaaaggagcttcagtattgtggggctcataaaacatgaatcaagcaatccagcctcatgggaagtcctggcacagtttttgtaaagcccttgcacagctggagaaatggcatcattataagctatgagttgaaatgttctgtcaaatgtgtctcacatctacacgtggcttggaggcttttatggggccctgtccaggtagaaaagaaatggtatgtagagcttagatttccctattgtgacagagccatggtgtgtttgtaataataaaaccaaagaaacata

SEQ ID NO: 299 - DNA, 1004 bp, Homo sapiens
acttgaactccatttcatcttttttcataccatctctaagattgctgccgcatttgcttgttaaactgaaagcatgtttcttgcaaaggctctattggaaggagcagatcgaggtcttggagaagctcttggaggcctctttggaggaggtggtcagagaagagaaggaggaggaagaaatattggagggatagttggaggaattgtgaattttatcagtgaggctgcagcagctcagtatactccagaaccgcctcccactcagcagcatttcaccagtgtggaggcctcagaaagtgaggaagttaggcgatttcggcaacaatttacacagctggctggaccagacatggaggtgggtgccactgatctgatgaatattctcaacaaagtcctttctaagcacaaagatcttaagactgacggttttagtcttgacacctgccggagcattgtgtctgtcatggacagtgacacgactggtaagctgggctttgaagaatttaagtatctgtggaacaacatcaagaaatggcagtgtgtttataagcagtatgacagggaccattctgggtctctgggaagttctcagctgcggggagctctgcaggccgcaggcttccagctaaatgaacaactttaccaaatgattgtccgccggtatgctaatgaagatggagatatggattttaacaatttcatcagctgcttggtccgcctggatgccatgtttcgtgccttcaagtctctggatagagatagagatggcctgattcaagtgtctatcaaagaatggctgcagttgaccatgtattcctgaagtgggaactgagaagtcaagatcctccctggaggacaggactgaaaaccttgccaagctgtacacagttgctgataccctgtgcaacagctctcatttcctggcaagctctttcacaaccctacatatttctgatcatgtgctgccttttactgctgaattaaaacagatatttcacgaaaaa

SEQ ID NO: 300 - DNA, 1420 bp, Homo sapiens
gttcgcctgcgtcgctccgggagctgccgacggacggagcgcccccgcccccgcccggccgcccgcccgccgccgccatgcccttctccaacagccacaacgcactgaagctgcgcttcccggccgaggacgagttccccgacctgagcgcccacaacaaccacatggccaaggtgctgacccccgagctgtacgcggagctgcgcgccaagagcacgccgagcggcttcacgctggacgacgtcatccagacaggcgtggacaacccgggccacccgtacatcatgaccgtgggctgcgtggcgggcgacgaggagtcctacgaagtgttcaaggatctcttcgaccccatcatcgaggaccggcacggcggctacaagcccagcgatgagcacaagaccgacctcaaccccgacaacctgcagggcggcgacgacctggaccccaactacgtgctgagctcgcgggtgcgcacgggccgcagcatccgtggcttctgcctccccccgcactgcagccgcggggagcgccgcgccatcgagaagctcgcggtggaagccctgtccagcctggacggcgacctggcgggccgatactacgcgctcaagagcatgacggaggcggagcagcagcagctcatcgacgaccacttcctcttcgacaagcccgtgtcgcccctgctgctggcctcgggcatggcccgcgactggcccgacgcccgcggtatctggcacaatgacaataagaccttcctggtgtgggtcaacgaggaggaccacctgcgggtcatctccatgcagaaggggggcaacatgaaggaggtgttcacccgcttctgcaccggcctcacccagattgaaactctcttcaagtctaaggactatgagttcatgtggaaccctcacctgggctacatcctcacctgcccatccaacctgggcaccgggctgcgggcaggtgtgcatatcaagctgcccaacctgggcaagcatgagaagttctcggaggtgcttaagcggctgcgacttcagaagcgaggcacaggcggtgtggacacggctgcggtgggcggggtcttcgacgtctccaacgctgaccgcctgggcttctcagaggtggagctggtgcagatggtggtggacggagtgaagctgctcatcgagatggagcagcggctggagcagggccaggccatcgacgacctcatgcctgcccagaaatgaagcccggcccacacccgacaccagccctgctgcttcctaacttattgcctgggcagtgcccaccatgcacccctgatgttcgccgtctggcgagcccttagccttgctgtagagacttccgtcacccttggtagagtttatttttttgatggctaagatactgctgatgctgaaataaactagggttttggcctgcc

SEQ ID NO: 301 - DNA, 3446 bp, Homo sapiens
gtctcagttcccgagcctgggagcaaccgcagcttctagtatccagactccagcgccgccccgggcgcggaccccaaccccgacccagagcttctccagcggcggcgcagcgagcagggctccccgccttaacttcctccgcggggcccagccaccttcgggagtccgggttgcccacctgcaaactctccgccttctgcacctgccacccctgagccagcgcgggcgcccgagcgagtcatggccaacgcggggctgcagctgttgggcttcattctcgccttcctgggatggatcggcgccatcgtcagcactgccctgccccagtggaggatttactcctatgccggcgacaacatcgtgaccgcccaggccatgtacgaggggctgtggatgtcctgcgtgtcgcagagcaccgggcagatccagtgcaaagtctttgactccttgctgaatctgagcagcacattgcaagcaacccgtgccttgatggtggttggcatcctcctgggagtgatagcaatctttgtggccaccgttggcatgaagtgtatgaagtgcttggaagacgatgaggtgcagaagatgaggatggctgtcattgggggtgcgatatttcttcttgcaggtctggctattttagttgccacagcatggtatggcaatagaatcgttcaagaattctatgaccctatgaccccagtcaatgccaggtacgaatttggtcaggctctcttcactggctgggctgctgcttctctctgccttctgggaggtgccctactttgctgttcctgtccccgaaaaacaacctcttacccaacaccaaggccctatccaaaacctgcaccttccagcgggaaagactacgtgtgacacagaggcaaaaggagaaaatcatgttgaaacaaaccgaaaatggacattgagatactatcattaacattaggaccttagaattttgggtattgtaatctgaagtatggtattacaaaacaaacaaacaaacaaaaaacccatgtgttaaaatactcagtgctaaacatggcttaatcttattttatcttctttcctcaatataggagggaagatttttccatttgtattactgcttcccattgagtaatcatactcaactgggggaaggggtgctccttaaatatatatagatatgtatatatacatgtttttctattaaaaatagacagtaaaatactattctcattatgttgatactagcatacttaaaatatctctaaaataggtaaatgtatttaattccatattgatgaagatgtttattggtatattttctttttcgtctatatatacatatgtaacagtcaaatatcatttactcttcttcattagctttgggtgcctttgccacaagacctagcctaatttaccaaggatgaattctttcaattcttcatgcgtgcccttttcatatacttattttattttttaccataatcttatagcacttgcatcgttattaagcccttatttgttttgtgtttcattggtctctatctcctgaatctaacacatttcatagcctacattttagtttctaaagccaagaagaatttattacaaatcagaactttggaggcaaatctttctgcatgaccaaagtgataaattcctgttgaccttcccacacaatccctgtactctgacccatagcactcttgtttgctttgaaaatatttgtccaattgagtagctgcatgctgttcccccaggtgttgtaacacaactttattgattgaatttttaagctacttattcatagttttatatccccctaaactacctttttgttccccattccttaattgtattgttttcccaagtgtaattatcatgcgttttatatcttcctaataaggtgtggtctgtttgtctgaacaaagtgctagactttctggagtgataatctggtgacaaatattctctctgtagctgtaagcaagtcacttaatctttctacctcttttttctatctgccaaattgagataatgatacttaaccagttagaagaggtagtgtgaatattaattagtttatattactctcattctttgaacatgaactatgcctatgtagtgtctttatttgctcagctggctgagacactgaagaagtcactgaacaaaacctacacacgtaccttcatgtgattcactgccttcctctctctaccagtctatttccactgaacaaaacctacacacataccttcatgtggttcagtgccttcctctctctaccagtctatttccactgaacaaaacctacgcacataccttcatgtggctcagtgccttcctctctctaccagtctatttccattctttcagctgtgtctgacatgtttgtgctctgttccattttaacaactgctcttacttttccagtctgtacagaatgctatttcacttgagcaagatgatgtaatggaaagggtgttggcattggtgtctggagacctggatttgagtcttggtgctatcaatcaccgtctgtgtttgagcaaggcatttggctgctgtaagcttattgcttcatctgtaagcggtggtttgtaattcctgatcttcccacctcacagtgatgttgtggggatccagtgagatagaatacatgtaagtgtggttttgtaatttaaaaagtgctatactaagggaaagaattgaggaattaactgcatacgttttggtgttgcttttcaaatgtttgaaaacaaaaaaaatgttaagaaatgggtttcttgccttaaccagtctctcaagtgatgagacagtgaagtaaaattgagtgcactaaacaaataagattctgaggaagtcttatcttctgcagtgagtatggcccgatgctttctgtggctaaacagatgtaatgggaagaaataaaagcctacgtgttggtaaatccaacagcaagggagatttttgaatcataataactcataaggtgctatctgttcagtgatgccctcagagctcttgctgttagctggcagctgacgctgctaggatagttagtttggaaatggtacttcataataaactacacaaggaaagtcagccactgtgtcttatgaggaattggacctaataaattttagtgtgccttccaaacctgagaatatatgcttttggaagttaaaatttaaatggcttttgccacatacatagatcttcatgatgtgtgagtgtaattccatgtggatatcagttaccaaacattacaaaaaaattttatggcccaaaatgaccaacgaaattgttacaatagaatttatccaattttgatctttttatattcttctaccacacctggaaacagaccaatagacattttggggttttataataggaatttgtataaagcattactctttttcaataaattgttttttaatttaaaaaaa

SEQ ID NO: 302 - DNA, 2052 bp, Homo sapiens
tgtgtgtgtgctcacacccacacgtgtgactttgcacgcatttgtctttgagagagagataatagtttttgtttttctttcagtagccaaagtttaaaccattgctttttctttgattctatcgcttttaaggtgatctttcttaacacaggataagaaagcagtaatgtcctaaagaatgctgttgaattaattagtatcagcctctcctacagttctggaaggatacgtggttaagtaccactcctggatgaatcagaaaaacagccacttgagcaatttcgtgttctgtggttcagatgagaatcccagttgagaaagtaagaaaatatgtgtttattcttcagctttaaattgttatatcacaaacttccttcctccttggcaagctttcttttttgacgagaagaaaattgtaataaacaacagtatgactaatagatagtcacatggttacttccagtttgcaaaatgctatttatactttgagttactcttcaaaagtggtatacctctagtttggagctgtgctgtaaaaacaagagtaacatttttatattaaagttaaataaagttacaactttgaagagagtttctgcaagacatgacacaaagctgctagcagaaaatcaaaacgctgattaaaagaagcacggtatgatgaccaaacataaaaagtgttttataattgttggtgttttaataacaactaatattattactctgatagttaaactaactcgagattctcagagtttatgcccctatgattggattggtttccaaaacaaatgctattatttctctaaagaagaaggagattggaattcaagtaaatacaactgttccactcaacatgccgacctaactataattgacaacatagaagaaatgaattttcttaggcggtataaatgcagttctgatcactggattggactgaagatggcaaaaaatcgaacaggacaatgggtagatggagctacatttaccaaatcgtttggcatgagagggagtgaaggatgtgcctacctcagcgatgatggtgcagcaacagctagatgttacaccgaaagaaaatggatttgcaggaaaagaatacactaagttaatgtctaagataatggggaaaatagaaaataacattattaagtgtaaaaccagcaaagtacttttttaattaaacaaagttcgagttttgtacctgtctggttaattctgcttacgtgtcaggctacacataaaagccacttcaaagattggcaaaaaatggttacaggtattctgctgagtttttttctttctttctttctctctctctctttctttctttctttctttctttctttttttaactgtaaaccagaaaacaattgtggggatcaaggacagacatagcacttagacaggactttcatgacccaatatggaacaatttgagtaccagaataggagattatggcctattgaacaaaatgtgaaactgggagtccacaaagacataaatggaaagatgaagtacctcctgacagagcaagaatggcactgaacaatgttatatggacaatggctattttattcaagactattacaatagggaaaagagactaggactcagtctgaactgaaatctgtcaaaacaaaggggggtggggctttaagagtgaaggtgaggaggagatcacacaccgtatgtgtttgctaactggctttacccaaaagaaaattaaactttctttgatctgtacaagttgatcaaacaaatggggtcattcttgtcatatgcaactaaaacagggtagacaggccaggggaaaaaggcactcagggcacacagcattgcttcaaaatataattctctacaaacctagttgctaaaactacctgttgtaacctaaaaccagttttatctaacagctattaaaacaacctactgtgactgcaaaactggttttacccaccactgtcacacaccaatcagaacttgccagctcctcaaaactttactagggccaataaactttctttcaaaacaataaaaaaaaaaaaaaa

SEQ ID NO: 303 - DNA, 8290 bp, Homo sapiens
gcgcccaggagcagagccgcgctcgctccactcagctcccagctcccaggactccgctggctcctcgcaagtcctgccgcccagcccgccgggatgcagtccgggccgcggcccccacttccagcccccggcctggccttggctttgaccctgactatgttggccagacttgcatccgcggcttccttcttcggtgagaaccacctggaggtgcctgtggccacggctctgaccgacatagacctgcagctgcagttctccacgtcccagcccgaagccctccttctcctggcagcaggcccagctgaccacctcctgctgcagctctactctggacgcctgcaggtcagacttgttctgggccaggaggagctgaggctgcagactccagcagagacgctgctgagtgactccatcccccacactgtggtgctgactgtcgtagagggctgggccacgttgtcagtcgatgggtttctgaacgcctcctcagcagtcccaggagcccccctagaggtcccctatgggctctttgttgggggcactgggacccttggcctgccctacctgaggggaaccagccgacccctgaggggttgcctccatgcagccaccctcaatggccgcagcctcctccggcctctgacccccgatgtgcatgagggctgtgctgaagagttttctgccagtgatgatgtggccctgggcttctctgggccccactctctggctgccttccctgcctggggcactcaggacgaaggaaccctagagtttacactcaccacacagagccggcaggcacccttggccttccaggcagggggccggcgtggggacttcatctatgtggacatatttgagggccacctgcgggccgtggtggagaagggccagggtaccgtattgctccacaacagtgtgcctgtggccgatgggcagccccatgaggtcagtgtccacatcaatgctcaccggctggaaatctccgtggaccagtaccctacgcatacttcgaaccgaggagtcctcagctacctggagccacggggcagtctccttctcggggggctggatgcagaggcctctcgtcacctccaggaacaccgcctgggcctgacaccagaggccaccaatgcctccctgctgggctgcatggaagacctcagtgtcaatggccagaggcgggggctgcgggaagctttgctgacgcgcaacatggcagccggctgcaggctggaggaggaggagtatgaggacgatgcctatggacattatgaagctttctccaccctggcccctgaggcttggccagccatggagctgcctgagccatgcgtgcctgagccagggctgcctcctgtctttgccaatttcacccagctgctgactatcagcccactggtggtggccgaggggggcacagcctggcttgagtggaggcatgtgcagcccacgctggacctgatggaggctgagctgcgcaaatcccaggtgctgttcagcgtgacccgaggggcacgccatggcgagctcgagctggacatcccgggagcccaggcacgaaaaatgttcaccctcctggacgtggtgaaccgcaaggcccgcttcatccacgatggctctgaggacacctccgaccagctggtgctggaggtgtcggtgacggctcgggtgcccatgccctcatgccttcggaggggccaaacatacctcctgcccatccaggtcaaccctgtcaatgacccaccccacatcatcttcccacatggcagcctcatggtgatcctggaacacacgcagaagccgctggggcctgaggttttccaggcctatgacccggactctgcctgtgagggcctcaccttccaggtccttggcacctcctctggcctccccgtggagcgccgagaccagcctggggagccggcgaccgagttctcctgccgggagttggaggccggcagcctagtctatgtccaccgcggtggtcctgcacaggacttgacgttccgggtcagcgatggactgcaggccagccccccggccacgctgaaggtggtggccatccggccggccatacagatccaccgcagcacagggttgcgactggcccaaggctctgccatgcccatcttgcccgccaacctgtcggtggagaccaatgccgtggggcaggatgtgagcgtgctgttccgcgtcactggggccctgcagtttggggagctgcagaagcagggggcaggtggggtggagggtgctgagtggtgggccacacaggcgttccaccagcgggatgtggagcagggccgcgtgaggtacctgagcactgacccacagcaccacgcttacgacaccgtggagaacctggccctggaggtgcaggtgggccaggagatcctgagcaatctgtccttcccagtgaccatccagagagccactgtgtggatgctgcggctggagccactgcacactcagaacacccagcaggagaccctcaccacagcccacctggaggccaccctggaggaggcaggcccaagccccccaaccttccattatgaggtggttcaggctcccaggaaaggcaaccttcaactacagggcacaaggctgtcagatggccagggcttcacccaggatgacatacaggctggccgggtgacctatggggccacagcacgtgcctcagaggcagtcgaggacaccttccgtttccgtgtcacagctccaccatatttctccccactctataccttccccatccacattggtggtgacccagatgcgcctgtcctcaccaatgtcctcctcgtggtgcctgagggtggtgagggtgtcctctctgctgaccacctctttgtcaagagtctcaacagtgccagctacctctatgaggtcatggagcggccccgccatgggaggttggcttggcgtgggacacaggacaagaccactatggtgacatccttcaccaatgaagacctgttgcgtggccggctggtctaccagcatgatgactccgagaccacagaagatgatatcccatttgttgctacccgccagggcgagagcagtggtgacatggcctgggaggaggtacggggtgtcttccgagtggccatccagcccgtgaatgaccacgcccctgtgcagaccatcagccggatcttccatgtggcccggggtgggcggcggctgctgactacagacgacgtggccttcagcgatgctgactcgggctttgctgacgcccagctggtgcttacccgcaaggacctcctctttggcagtatcgtggccgtagatgagcccacgcggcccatctaccgcttcacccaggaggacctcaggaagaggcgagtactgttcgtgcactcaggggctgaccgtggctggatccagctgcaggtgtccgacgggcaacaccaggccactgcgctgctggaggtgcaggcctcggaaccctacctccgtgtggccaacggctccagccttgtggtccctcaaggaggccagggcaccatcgacacggccgtgctccacctggacaccaacctcgacatccgcagtggggatgaggtccactaccacgtcacagctggccctcgctggggacagctagtccgggctggtcagccagccacagccttctcccagcaggacctgctggatggggccgttctctatagccacaatggcagcctcagcccccgcgacaccatggccttctccgtggaagcagggccagtgcacacggatgccaccctacaagtgaccattgccctagagggcccactggccccactgaagctggtccggcacaagaagatctacgtcttccagggagaggcagctgagatcagaagggaccagctggaggcagcccaggaggcagtgccacctgcagacatcgtattctcagtgaagagcccaccgagtgccggctacctggtgatggtgtcgcgtggcgccttggcagatgagccacccagcctggaccctgtgcagagcttctcccaggaggcagtggacacaggcagggtcctgtacctgcactcccgccctgaggcctggagcgatgccttctcgctggatgtggcctcaggcctgggtgctcccctcgagggcgtccttgtggagctggaggtgctgcccgctgccatcccactagaggcgcaaaacttcagcgtccctgagggtggcagcctcaccctggcccctccactgctccgtgtctccgggccctacttccccactctcctgggcctcagcctgcaggtgctggagccaccccagcatggagccctgcagaaggaggacggacctcaagccaggaccctcagcgccttctcctggagaatggtggaagagcagctgatccgctacgtgcatgacgggagcgagacactgacagacagttttgtcctgatggctaatgcctccgagatggatcgccagagccatcctgtggccttcactgtcactgtcctgcctgtcaatgaccaaccccccatcctcactacaaacacaggcctgcagatgtgggagggggccactgcgcccatccctgcggaggctctgaggagcacggacggcgactctgggtctgaggatctggtctacaccatcgagcagcccagcaacgggcgggtagtgctgcggggggcgccgggcactgaggtgcgcagcttcacgcaggcccagctggacggcgggctcgtgctgttctcacacagaggaaccctggatggaggcttccgcttccgcctctctgacggcgagcacacttcccccggacacttcttccgagtgacggcccagaagcaagtgctcctctcgctgaagggcagccagacactgactgtctgcccagggtccgtccagccactcagcagtcagaccctcagggccagctccagcgcaggcactgacccccagctcctgctctaccgtgtggtgcggggcccccagctaggccggctgttccacgcccagcaggacagcacaggggaggccctggtgaacttcactcaggcagaggtctacgctgggaatattctgtatgagcatgagatgccccccgagcccttttgggaggcccatgataccctagagctccagctgtcctcgccgcctgcccgggacgtggccgccacccttgctgtggctgtgtcttttgaggctgcctgtccccagcgccccagccacctctggaagaacaaaggtctctgggtccccgagggccagcgggccaggatcaccgtggctgctctggatgcctccaatctcttggccagcgttccatcaccccagcgctcagagcatgatgtgctcttccaggtcacacagttccccagccggggccagctgttggtgtccgaggagcccctccatgctgggcagccccacttcctgcagtcccagctggctgcagggcagctagtgtatgcccacggcggtgggggcacccagcaggatggcttccactttcgtgcccacctccaggggccagcaggggcctccgtggctggaccccaaacctcagaggcctttgccatcacggtgagggatgtaaatgagcggccccctcagccacaggcctctgtcccactccggctcacccgaggctctcgtgcccccatctcccgggcccagctgagtgtggtggacccagactcagctcctggggagattgagtacgaggtccagcgggcaccccacaacggcttcctcagcctggtgggtggtggcctggggcccgtgacccgcttcacgcaagccgatgtggattcagggcggctggccttcgtggccaacgggagcagcgtggcaggcatcttccagctgagcatgtctgatggggccagcccacccctgcccatgtccctggctgtggacatcctaccatccgccatcgaggtgcagctgcgggcacccctggaggtgccccaagctttggggcgctcctcactgagccagcagcagctccgggtggtttcagatcgggaggagccagaggcagcataccgcctcatccagggaccccagtatgggcatctcctggtgggcgggcggcccacctcggccttcagccaattccagatagaccagggcgaggtggtctttgccttcaccaacttctcctcctctcatgaccacttcagagtcctggcactggctaggggtgtcaatgcatcagccgtagtgaacgtcactgtgagggctctgctgcatgtgtgggcaggtgggccatggccccagggtgccaccctgcgcctggaccccaccgtcctagatgctggcgagctggccaaccgcacaggcagtgtgccgcgcttccgcctcctggagggaccccggcatggccgcgtggtccgcgtgccccgagccaggacggagcccgggggcagccagctggtggagcagttcactcagcaggaccttgaggacgggaggctggggctggaggtgggcaggccagaggggagggcccccggccccgcaggtgacagtctcactctggagctgtgggcacagggcgtcccgcctgctgtggcctccctggactttgccactgagccttacaatgctgcccggccctacagcgtggccctgctcagtgtccccgaggccgcccggacggaagcagggaagccagagagcagcacccccacaggcgagccaggccccatggcatccagccctgagcccgctgtggccaagggaggcttcctgagcttccttgaggccaacatgttcagcgtcatcatccccatgtgcctggtacttctgctcctggcgctcatcctgcccctgctcttctacctccgaaaacgcaacaagacgggcaagcatgacgtccaggtcctgactgccaagccccgcaacggcctggctggtgacaccgagacctttcgcaaggtggagccaggccaggccatcccgctcacagctgtgcctggccaggggccccctccaggaggccagcctgacccagagctgctgcagttctgccggacacccaaccctgcccttaagaatggccagtactgggtgtgaggcctggcctgggcccagatgctgatcgggccagggacaggcttgcccatgtcccgggccccattgcttccatgcctggtgctgtctgagtatccccagagcaagagagacctggagacaccaggggtggagggtcctgggagatagtcccaggggtccgggacagagtggagtcaagagctggaacctccctcagctcactccgagcctggagaactgcaggggccaaggtggaggcaggcttaagttcagtcctcctgccctggagctggtttgggctgtcaaaaccagggtaacctcctacatgggtcatgactctgggtcctgggtctgtgaccttgggtaagtcgcgcctgacccaggctgctaagagggcaaggagaaggaagtaccctggggagggaagggacagaggaagctattcctggcttttccactccaacccaggccaccctttgtctctgccccagagttgagaaaaaaacttcctcccctggttttttagggagatggtatcccctggagtagagggcaagaggagagagcgcctccagtctagaaggcataagccaataggataatatattcagggtgcagggtgggtaggttgctctggggatgggtttatttaagggagattgcaaggaagctatttaacatggtgctgagctagccaggactgatggagcccctgggggtgtgggatggaggagggtctgcagccagttcattcccagggccccatcttgatgggccaagggctaaacatgcatgtgtcagtggctttggagcaggttaggctggggctcatcgagggtctcaggccgaggccactgcggtgccagtgcccccctgaggactagggcaggcagctgggggcacttggttccatggagcctggataaacagtgctttggaggctctggacagctgtgtggtgtttgtgtcttaactatgcactgggcccttgtctgcgtcggcttgcatacagagggcccctggggtcggccctccggcctggcctcagccagtgggatggacagggccaggcaggcctctgaacttccacctcctggggcctcccagacctcctgtgcccccacctgtgtgggcaggtgggccagtcttcgggtgatgggaccaaaccccttcagttcagtagagaaaggctaggtcctctacaaagagctgcaagacaaaaattaaaataaatgctccccaccctaga

SEQ ID NO: 304 - DNA, 4522 bp, Homo sapiens
gggagttgatccagaattgtctttctgaaaggaagcactcggaatccttccgaactttccaagtccatccatgattcagagatactgccttctctctctctgggattttatgtgtttctgatagtgaattgttgatgtatttgctactttgcttcttttctctttcaagacttgatcattttatatgctgtttggagaaaaaaagaacttttgttagcaaggaggtttcagaaatgattttggattttctgtaagtgtttaatttagttctaggggacagcatctctcatcccggagtaaatttctgcctttgacctgcatggattattttttcaggctgcggaatttctcggcacctacctgtagtatggggcacttggtttggttgcagagtaagaaggtggaagaatgagctgtacttggttaagcagttgaaaccttttttgagcaggatctgtaaaagcataattgaatttgtttcacccccgtggattccagtgggcccgacagcgcaacagtgcctggcaacttgatgcatatggaagagcaatgccaagtgatctgacataatacaaattcacgaagtgacattcaatcacaagcaaagttggaaattccaaagagaagtggtgagatctttactagtcacagtgaagatgggagaaaatgacatacctgcagcagatgtgggctgaaaatatcctcttctctgcccaatcaggaatgctacctgtttttgggaataaactttagagaaaggaagggccaaaactacgacttggctttctgaaacggaagcataaatgttcttttcctccatttgtctggatctgagaacctgcatttggtattagctagtggaagcagtatgtatggttgaagtgcattgctgcagctggtagcatgagtggtggccaccagctgcagctggctgccctctggccctggctgctgatggctaccctgcaggcaggctttggacgcacaggactggtactggcagcagcggtggagtctgaaagatcagcagaacagaaagctattatcagagtgatccccttgaaaatggaccccacaggaaaactgaatctcactttggaaggtgtgtttgctggtgttgctgaaataactccagcagaaggaaaattaatgcagtcccacccgctgtacctgtgcaatgccagtgatgacgacaatctggagcctggattcatcagcatcgtcaagctggagagtcctcgacgggccccccgcccctgcctgtcactggctagcaaggctcggatggcgggtgagcgaggagccagtgctgtcctctttgacatcactgaggatcgagctgctgctgagcagctgcagcagccgctggggctgacctggccagtggtgttgatctggggtaatgacgctgagaagctgatggagtttgtgtacaagaaccaaaaggcccatgtgaggattgagctgaaggagcccccggcctggccagattatgatgtgtggatcctaatgacagtggtgggcaccatctttgtgatcatcctggcttcggtgctgcgcatccggtgccgcccccgccacagcaggccggatccgcttcagcagagaacagcctgggccatcagccagctggccaccaggaggtaccaggccagctgcaggcaggcccggggtgagtggccagactcagggagcagctgcagctcagcccctgtgtgtgccatctgtctggaggagttctctgaggggcaggagctacgggtcatttcctgcctccatgagttccatcgtaactgtgtggacccctggttacatcagcatcggacttgccccctctgcatgttcaacatcacagagggagattcattttcccagtccctgggaccctctcgatcttaccaagaaccaggtcgaagactccacctcattcgccagcatcccggccatgcccactaccacctccctgctgcctacctgttgggcccttcccggagtgcagtggctcggcccccacgacctggtcccttcctgccatcccaggagccaggcatgggccctcggcatcaccgcttccccagagctgcacatccccgggctccaggagagcagcagcgcctggcaggagcccagcacccctatgcacaaggctggggactgagccacctccaatccacctcacagcaccctgctgcttgcccagtgcccctacgccgggccaggccccctgacagcagtggatctggagaaagctattgcacagaacgcagtgggtacctggcagatgggccagccagtgactccagctcagggccctgtcatggctcttccagtgactctgtggtcaactgcacggacatcagcctacagggggtccatggcagcagttctactttctgcagctccctaagcagtgactttgaccccctagtgtactgcagccctaaaggggatccccagcgagtggacatgcagcctagtgtgacctctcggcctcgttccttggactcggtggtgcccacaggggaaacccaggtttccagccatgtccactaccaccgccaccggcaccaccactacaaaaagcggttccagtggcatggcaggaagcctggcccagaaaccggagtcccccagtccaggcctcctattcctcggacacagccccagccagagccaccttctcctgatcagcaagtcaccagatccaactcagcagccccttcggggcggctctctaacccacagtgccccagggccctccctgagccagcccctggcccagttgacgcctccagcatctgccccagtaccagcagtctgttcaacttgcaaaaatccagcctctctgcccgacacccacagaggaaaaggcgggggggtccctccgagcccacccctggctctcggccccaggatgcaactgtgcacccagcttgccagatttttccccattacacccccagtgtggcatatccttggtccccagaggcacaccccttgatctgtggacctccaggcctggacaagaggctgctaccagaaaccccaggcccctgttactcaaattcacagccagtgtggttgtgcctgactcctcgccagcccctggaaccacatccacctggggaggggccttctgaatggagttctgacaccgcagagggcaggccatgcccttatccgcactgccaggtgctgtcggcccagcctggctcagaggaggaactcgaggagctgtgtgaacaggctgtgtgagatgttcaggcctagctccaaccaagagtgtgctccagatgtgtttgggccctacctggcacagagtcctgctcctgggaaaggaaaggaccacagcaaacaccattctttttgccgtacttcctagaagcactggaagaggactggtgatggtggagggtgagagggtgccgtttcctgctccagctccagaccttgtctgcagaaaacatctgcagtgcagcaaatccatgtccagccaggcaaccagctgctgcctgtggcgtgtgtgggctggatcccttgaaggctgagtttttgagggcagaaagctagctatgggtagccaggtgttacaaaggtgctgctccttctccaacccctacttggtttccctcaccccaagcctcatgttcataccagccagtgggttcagcagaacgcatgacaccttatcacctccctccttgggtgagctctgaacaccagctttggcccctccacagtaaggctgctacatcaggggcaaccctggctctatcattttccttttttgccaaaaggaccagtagcataggtgagccctgagcactaaaaggaggggtccctgaagctttcccactatagtgtggagttctgtccctgaggtgggtacagcagccttggttcctctgggggttgagaataagaatagtggggagggaaaaactcctccttgaagatttcctgtctcagagtcccagagaggtagaaaggaggaatttctgctggactttatctgggcagaggaaggatggaatgaaggtagaaaaggcagaattacagctgagcggggacaacaaagagttcttctctgggaaaagttttgtcttagagcaaggatggaaaatggggacaacaaaggaaaagcaaagtgtgacccttgggtttggacagcccagaggcccagctccccagtataagccatacaggccagggacccacaggagagtggattagagcacaagtctggcctcactgagtggacaagagctgatgggcctcatcagggtgacattcaccccagggcagcctgaccactcttggcccctcaggcattatcccatttggaatgtgaatgtggtggcaaagtgggcagaggaccccacctgggaacctttttccctcagttagtggggagactagcacctaggtacccacatgggtatttatatctgaaccagacagacgcttgaatcaggcactatgttaagaaatatatttatttgctaatatatttatccacaaa

SEQ ID NO: 305 - DNA, 5492 bp, Homo sapiens
actctgggcccctgctccgcgcgctagctggctgtgtggctcgctggctcgctagggacaagcaggaatcggagcagcactgccgcctctggcgcgaaggctcaggcgcctcctcccgccacagtcactgtggctcggcgcacgctgccggcggctgccctttccgcctctggggaagaaaaacccgcgggccgctttcgtgcttgaaccatggcctcgggccggaggggctgggacagctcccacgaagacgatctgcccgtgtacctggccaggccgggcaccacggaccaggtcccgcggcagaaatacggcggcatgttctgcaacgtggagggcgccttcgagagcaagacgctggatttcgatgccctcagcgtggggcagcggggcgcgaagactcctcggagcggccagggcagcgaccgaggatcggggagtcggcccgggatcgagggggacaccccgcgcaggggccaaggccgggaagagagcagggagcccgcgcccgcctcccccgcccccgccggggtagagatccggagcgccaccggcaaagaggtgttgcagaacctcggccccaaggacaagagtgaccgtctccttatcaagggaggcagaatcgtcaatgatgatcagtccttttatgctgatatttacatggaagatggcttaataaaacaaattggagacaatctgattgttcctggaggagtgaagaccattgaagccaatgggaagatggtgatccctggaggcatcgatgtccatactcacttccagatgccatataagggaatgaccacagtagatgacttcttccaagggacaaaggcggccttagcaggtggcaccaccatgatcattgaccatgtggtgcctgagcctgagtccagcctgactgaggcctatgagaaatggagagagtgggctgatgggaagagttgctgtgactatgccctgcatgtggacatcacccactggaatgacagcgtcaagcaggaagtgcagaacctcatcaaggacaaaggggttaactccttcatggtttatatggcttataaggatttgtatcaagtatctaacacagagctctatgagatcttcacctgcctgggagagctgggggccattgctcaagttcatgctgagaatggggatatcattgcccaggagcaaacccgcatgttggaaatggggataactggcccagaaggccatgtactgagcaggccagaagagctggaagctgaggctgtgttccgtgccatcaccattgccagccaaaccaattgccctctctacgtcacaaaggtcatgagcaagagtgcagctgacctcatctcacaagccaggaaaaaaggaaatgtagtctttggtgagcccatcactgccagcctcggcatagatggaacccattattggagcaagaactgggccaaggcggctgcatttgtgacatccccacccctgagccctgacccaactactccggactacatcaactccttgctggccagcggggatctgcagctatctgggagtgcccactgcaccttcagcactgcccagaaagcaattgggaaggacaacttcacagccattcctgagggcaccaatggtgtggaggagcggatgtctgtcatctgggacaaggctgtggccacagggaaaatggacgaaaaccagttcgtggctgtgacaagcacaaacgctgccaagatcttcaacctgtatccccgcaagggaagaatatctgtgggttctgacagcgacctcgtcatctgggatccagatgctgtgaagatcgtctctgccaagaaccaccagtctgcggcagagtacaacatctttgaagggatggagctgcgcggggctcctctggttgtcatctgccagggcaagatcatgctggaagatggcaacctgcacgtgacccagggggctggccgcttcataccctgcagcccgttctccgactatgtctacaagcgcattaaagcacggaggaagatggcagacctgcatgccgtcccaaggggcatgtacgatgggcctgtgtttgacctgaccaccacccccaaaggtggcacccccgcaggctctgctcggggctctcctactcggccgaacccacctgtgaggaatcttcatcagtcgggatttagcctgtcaggcacccaagtggatgagggggttcgctcagccagcaagcgcatcgtggcgcccccaggcggccgttctaatatcacatctctgagttaagcaagccttcctcaaagagaggggcagaagcaagaagagattgttttgaagccaaaatggtacaccgatatttaagaaggaaagcgaatccaaacggttgtgatctaaagaatcaataagcctcaagccttatgtttctccaatgttacgctcgcttgcctagctttacgaatattgctttgttttctgtttatgcatagccttgatttgtttgactcccctccccccatttacatgcatgcaatcagacaggccactaaggtaaaagagtctgctctatcatagtgttgagagcgtgtgtagtgctgcatcttatgacaaggggacagacaagctgggacgtcagggaaatgaacaaaagggacgcaggttatttggggtgagtgggtggtgggagcctggagcaaggtggagggtgcagaggggctggggtagggcatgtaggagggaggtgggtgggtcaggtgagtggaaggggtgttgtatattgtgttgatgacgtacgttatttccatggaagatagccgctgtggcagctgtcacatcaccacagctccctagggtctgccgagaaggcaggcagtctttgggttctgttctttgtcacgtcccctacaagtaaattttgtttctttgaacgtttattaaaatgccaagacccaaccatttcttccacctgcttgattgtgccagtgtttgctcaggcctctttcttagtgttgctttcaaatccttctctttcctgggttgggaaggccaggcagggacagagcaaatgacacttctcttcctcttgccctccctgcctctttggtgctcttaaaagccagcagctgagaacatagcacaggcccacgtggtgagggcacccacagcttaaagacgcttccttctaaacacggcgaggtcacctctcactcttctgtctttgcaaaccgagaagagtggcatgcttctggcatcccaagtcaggattttagctcagatgaggcagaatgaagggcctctcttacaggcagtttgtgtttgattctctcgatcctggcacatccatgataaataggagtttttgaaagttggttttattaggtgttccctaatttttaccgtaataggtcatctcagcttatatgaaagtcaagtggggaactgggaaagccaaagtcagtcttgagcagagggagcacattttgtggacctggttccacctttccattccaaaccacctgtttccccttccattagcagaaactctgggggaactttgtgtctcagtcctagaatctccccaagtgagtggaagtgacatgatgcagtcttcctcatggggcacctgaaagaaattagtgtgggtgcttcgatctaccttgtctgtcagagttgaatatctctttccctatcatgctgcttctgaaaattcagttttggagcaagtcctgtgagcaagataagaatctatagaaccaagatgctcattttcagaagaaatatgttcaacctgggatcagacttccatgctctggggaatccaagtggtagcacctgtaaccctgtgtactaagtgctttgaagagaagagcaggcctcagacaccttttaattgcttaggagaaaccattgtctctgactgcaggtttgaataagttgaagaccagagaaaagtacacactgggctacaaaggaatttggagatagccaaggaacaggatttcccctagcaagctaccttctgttcaaatcatgaaaaaagactatttccccttagaatagggaagcttgctattttaaagctcttgtagtgcttttcttttaagggagatgtagtaaaagggaaaatgtagctcttagtttacacttcaaagatgtgggggtctttcagagaactaagaataacagttttatgtgcagagagagtttgccagatctgaagcatatacctcattgactaggctgttactttgggataggttgcagtaccagccacagccagcagatagaggaaaagacacacataaactcgcttctgagcgtccacttctgcactctctgctctgctgttactcagcccctgagtctgactcatctctgcacaacctctctgtgccatgaagataagtcttccatggccaaatcggtcatccgcactgcccttgggacttccgaagtgaaccattccaccagaacctttgattctgcacaagatttccttgctctgggaacaacccccaaatgcccttgggaggaacaacatgagctcaggaagcctctctttcttcacttaccattactaactctccaagcatagaaatccctgggaattgcgagaataactcccactattttaaaatttatattcagatttgtttcgtttcataagacacatcaaacaggcctatacaaaaggtttaggaaaagaaaacaatggtgagtcccggccctcttcgaattcactggcacctcatgcaagtgtaggaaggcacgctggatcgtctatctgattccaaagctgtcctttgccatctcatcccttggcctgccccccaaccctgaggatgcccctgccatccccccaacctcctcatattgcctctgaacccagatggcaatccatcccggttctctctgagggccacgggcttgggtagtggaaagggtgtttgggaaattgttaaatcagttacccgtagtagagctatttcttgtacttctaagttttctagaagtggaaggattgtagtcatcctgaaaatgggtttacttcaaaatccctcagccttgttcttcacgactgtctatactgagagtgtcatgtttccacaaagggctgacacctgagcctggattttcactcatccctgagaagccctttccagtagggtgggcaattcccaacttccttgccacaagcttcccaggctttctcccctggaaaactccagcttgagtcccagatacactcatgggctgccctgggcagccagcattcattgtaagttccctctttgaaaactggtgtgtgggtgttcagttctgtgtctggtgggtatggacagacagtaatctcctgtgatctgtgctagctgtgaggcagctctggaacgtgaagagctgtttggtttgaaccgtgaacaaaactgtgttttgagtttagctgacattaaagaaaaaagttcatcacgtgactgttaatgtaaacctggttattaaaataactatgaaattaccaa

SEQ ID NO: 306 - DNA, 7310 bp, Homo sapiens
gcctctgccgctcctccgccccacggctcaggattcgcccaaaatgaggacttccctgcaggcagtggcactctggggacagaaggcccctccccacagcatcactgccatcatgatcactgatgaccagcgaacgattgtgactggaagtcaagagggtcagctctgtctctggaatctctcacatgaactaaagatttcagcgaaagaactcctatttggtcattcagcttcggtaacatgtttggcaagagcaagggacttctctaaacagccctacattgttagtgctgctgaaaatggggagatgtgtgtttggaatgtcaccaatggacagtgcatggagaaggctacacttccttacaggcacactgcaatctgttattaccactgctcattccggatgacaggagaaggctggcttctttgttgtggagaatatcaagatgtccttataattgatgccaaaactttggctgttgttcacagttttagatcatctcagtttcctgactggatcaactgcatgtgcattgttcactccatgagaattcaagaagattctctcttggtggtatcagtagctggtgagctcaaagtatgggatctttcctcatctatcaacagcattcaggaaaagcaagatgtctatgaaaaagaatccaagtttcttgagtccttgaactgccagacaattcgattttgcacatatactgagagacttctattggtggtattttctaaatgttggaaggtttatgattattgtgatttttcccttctgctgactgaagttagtagaaatgggcagttctttgctggtggagaagtgattgctgctcacagaatcctcatctggacagaagatggtcacagttacatctatcagctgctgaacagtgggctttcaaaaagcatataccctgctgatggaagagtgcttaaagagaccatttatcctcatttactgtgctctacttctgtgcaggaaaataaggaacagagccgtccctttgttatgggctacatgaatgaaaggaaagagcctttttacaaggtacttttctctggagaagtctcaggaagaattactttgtggcacatccctgatgttcctgtatccaagtttgatggttctcctagagagataccagtaactgccacctggactcttcaagataattttgataagcatgatactatgtcacaaagtattattgactatttctctgggcttaaagatggggcaggaactgctgtagtcacttcatcagagtatattccaagtcttgataaactaatatgtggctgtgaagatgggacaattatcattacccaggctttgaatgctgccaaagcaagacttctggaaggtggttctttagtaaaagattctccccctcataaagttcttaaaggccaccaccaaagtgtcacttcattactctatccacatggtctctcttcgaaattagaccaaagttggatgttgtctggggacctggactcatgtgtgatcttgtgggatatctttactgaagaaattttgcataaattctttttggaagctggtccagtaacaagtcttttgatgtcaccagagaagtttaaactaaggggtgagcagataatttgctgtgtgtgcggtgaccattccgtggctctccttcaccttgagggaaagagttgcctcctgcatgcccggaagcacctttttcctgtgaggatgataaaatggcacccggttgagaattttttaattgttggatgtgcagatgactcagtttatatctgggaaattgaaacaggcactttggaaagacatgagacaggagaaagagcacgaattattcttaattgttgtgatgattcacagcttgtgaagtctgtacttcccattgcctcagagacacttaagcacaaaagtatagaacagagatcctccagcccctaccagcttgggccattaccttgccctggtctgcaggtggagtcttcatgtaaggttactgatgccaaattttgcccaagaccttttaatgtcttgcctgtgaagacaaaatggagtaacgttggctttcatattcttctatttgatctggaaaaccttgttgaacttttgctaccaactccactcagtgatgttgactcttccagttcattctatggtggtgaggtcctgagaagagccaagagcacagtggagaagaagacactgacactgagaaaaagtaaaactgcctgtggtcctctttcagcagaggcactagccaagcctattactgaaagcctggcccaaggagataataccatcaaattctcagaagaaaatgatggcattaaaaggcagaagaaaatgaagatctccaaaaaaatgcagcctaagccatcaagaaaagtagatgccagtctcacaatagacacagcaaaattgtttctgtcttgccttttgccatggggagtggataaagatttagattatctttgcattaagcacctcaatattttaaagcttcagggtcctatttctttgggaatttctttgaatgaagataatttctcactgatgttgccaggttgggatttatgcaatagtggaatgataaaagactattcaggagtaaatttattttccaggaaagttttggacttgtcagataaatacacagccactcttccaaatcaggttggaattccaagaggattggaaaataattgtgattctttgcgagagtcagatactatagtttatttgttgagcagactatttttagttaataaattagttaacatgcctttagaattggcatgtagagttggcagttctttcagaatggaaagtatacataataagatgagaggtgctgggaatgacattttaaatatgtcaagcttctacagttgcttacgaaatggtaagaatgaatcccatgtacctgaggctgacctttcacttttgaagctaatttcctgttggagagaccagtctgtgcaggtaactgaagcaatacaagctgttctcttggcggaagttcaacaacacatgaagagtttgggaaagatacccgtcaatagtcaaccagtgtccatggcagagaatggtaactgtgagatgaagcagatgctgccaaagctggaatggacagaagaactagagttacagtgtgttagaaacactttgcctctgcaaactccagtcagcccggtcaagcatgacagcaactcaaactcggcaaacttccaagacgtggaggacatgcctgacagatgtgccttggaagagtctgagagtccaggtgagccaaggcatcattcatggatagcaaaggtctgcccctgcaaggtgtcttaaatggaatctcatcagtaggagctgaatttggacaaattaagaaatccaaaagatgccatttgtttattactgtataaaagcattgttgttattggtcaagttattaggctgtagtggatttgctaatactttagccaacatgtattaaagtgattttaatacatgctgattacaatgcaatacatactgattgaaaatattcatattcatctaattttagaaaaatattgcctagatcattctctattcctgtttcttactttttctgttaatatttccaacagggaatgccagtccacagacacaaatttaatactgctttaaattttctcctatccttttagtccctgaattatataataaacaatgttaaaaccaatgtagtacacaatacttacttacaaatttaatactgcttcaaggtatttaatctaaaattttaccaactttgatttgtctggttaggatattttgttttagtggatatgctttaattcggatcaattactgcagtaaatctcatccctaagcatgaaatgttgtcaacaaatacccagttccatttagttatcaattagcccaaataagagatacaaagtataacagtgaccaaccttgtactgttgagttaatttgaacttctaatgacattgaggctaatgtctttagctcaaggttgatcttgttggccatatagatgtgaactagggaaggggaatcaacttacagcatatcacaattgatccttattaagtataaactcttgtaggtcttttcccagaaagaagcttgactagcaggaattctaaaactgaaatatatcaaacagcataaataggaatagacataaagtgctcttctattaaagcctttggtgatctatttactatgatttatattgtacagttcctcgatttacagaaaatcatcaaaattattaatctacatatcttatgtatataaatattgcctaatccatagaaaaaaggatataaagtattaaatatgtgatatatagctatatctatctatctatgtatctaatagggaagtccaagtcacttcaattgaagaaacatatctctgagcataggagcagcctcaggtcctatggtgggatgcagtggacaggagagggggaaattagaaaagagaactatataattgaaaaagggatataaagcattaaatatatgatatatagctatatctatgtatgtatctaacagagaagttcaagtcacttcaattaaagaaacatttttgagcatgggaccagcctcaggtcttatgctgggatgcagtagacaggagatggggaaattagaaaagagaactgtgtaattgaaatgacgtgggctgcacccttaaggaacttataattaatgatgatctgaataaacataccaggataaagatgtcaaatgagtgtgactcccttaaagtagattaaagtgtgcattctttgtttcctaaaatatgattttactgcttgaaattacatttgagttgaagtttagaaactaacatagcattaatatgaataatcatggaaaattattatcctttgaaaactgattgataaatatattccccctcctttagaaacagtcaaaagccacttcaaacaagtttcaaaataaaggaaggtagcaagttaggcgatggattatattttcttgcttgttgtataccagttgtcaaggacattataaggactcccaaaagcattttgaaggatggcaatatcaaataagtgtatgtcctctcaaatgaggcatttttaattgttaaaatctatttggacgctcaggttatgatatgtttatgaaaaataagcttcattatttttatagctacatcctattattcccttttagaaacaagaataacaataggttttaatagttgccatacttagcatttatcagttctaatgaaaccaatattgaatctctgataaatattttctgatgttactagctatgggaaattagaactggcacaaccctgacattactaagtggaaatgttaggatttttcggcatcgcatgttagaatctctaaaatttaaacattcctgttaaatgactaaggtttgcttttatcaatatgaattctgaaggccaatatcataccattaactatgaaagcttttaattcctaaaaatagttttagagatattcaagcaatgctctcctaatatccatacgcaagtgtgtttatgacacaaattcactagtctgtttaaaaatgaattctttatattgactggtgttccacatatttcagtaatttctgttatgagaggacttgaaatagcaaattgccacacagttaactggatagaccacgtacgtggtgatcataaccacttggtactacacccagaaactcaaaattgtctttctcctgatgagatatgggtgtccttttgtacgtctaggcctaggtaaccagtggagtgattatattagcaaatgtgtttgtatccggagtcttcctgtcattgtaataaaaaatttatttaaaaattttgtcttgtgtttcttttttggtaatcatcttggtgatatttatgaatgtatttgtgtgtgtgtgtgtgtgtgtatacatacatatatatgtgtgtatatatatacacacatatatatacacatatatatgtgtgtatatatatatatatatggcatatcccccaaaggaatatcatattttcatttgcaagccttgattctttgacttgctgttgagtttcacattggctccattgtatattgcaggaaaaagtacctggaaagcctggagggttaaaagcagaggctcctcggcagcgtgtccaggccgtgtgtgcttgctgtgcttgtcagagcctcattccctcccctgtgttggagagctttctcacagggctcatccagaggtgctagaaagcaatgtgagcactattaaacacttcaaatataaggaaaaatgtataatgttagaaacacacagttaaaaagtagccccaggtatcaaacattctgttactattttagaaactaaattaaggctgctttgaacatgatggtattagaaaaatggtagaatacagtttgttaaatattaatattctatctttagatgatagcatttggtgacttttatttcttttctcatacattttttccagtgttctgtatttttaaaatcctttcataattattataatgaacactttagaaaagatactatttctcttccatccttagagggcacattataataattgagtattttaaaattaaattttatgccatgtatttaaaatgaaagttcaggttacattaattccaactgattttaaagccttattttcacagagtggactcattcaattttttaaattttatattcatacattttgattgctcagttatataaaagcggtgttatagactcctttattctccacaaaatgttgtcttatatgtaaagtgccaaaagttgtgtttaatttcctaagaaagtcattgctttgtaaacatttgcataatacttagtgttttttgtaattttaaaaaattagcttaaccaaaagagttgcaaaattaaaacttacttgagtaggtatctttcagacaaagctgcatggcttcatgtacaatagtccccagatcacctcgcactgtagtttgctcaagaaggagcctacagatggcaggtaggagaaggtaaactggaaattaacaggtctgtctgtaagagcatgccactggaaacacccatccaatttgggacccctggaagacagcatgtgtctaatgggaggcctgtcctagtacaactcctttactcttttcaccttcatcttgaccttctcagataccatctttatgtaaaatgttgatgttgtggagtttttgcagtaatttaatttttataaatattgtattaaaatatatttatcttga

SEQ ID NO: 307 - DNA, 9697 bp, Homo sapiens
cctctgcgcccttgccgccctccgagccacagctttcctcccgctcctgcccccggcccgtcgccgtctccgcgctcgcagcggcctcgggagggcccaggtagcgagcagcgacctcgcgagccttccgcactcccgcccggttccccggccgtccgcctatccttggccccctccgctttctccgcgccggcccgcctcgcttatgcctcggcgctgagccgctctcccgattgcccgccgacatgagctgcaacggaggctcccacccgcggatcaacactctgggccgcatgatccgcgccgagtctggcccggacctgcgctacgaggtgaccagcggcggcgggggcaccagcaggatgtactattctcggcgcggcgtgatcaccgaccagaactcggacggctactgtcaaaccggcacgatgtccaggcaccagaaccagaacaccatccaggagctgctgcagaactgctccgactgcttgatgcgagcagagctcatcgtgcagcctgaattgaagtatggagatggaatacaactgactcggagtcgagaattggatgagtgttttgcccaggccaatgaccaaatggaaatcctcgacagcttgatcagagagatgcggcagatgggccagccctgtgatgcttaccagaaaaggcttcttcagctccaagagcaaatgcgagccctttataaagccatcagtgtccctcgagtccgcagggccagctccaagggtggtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttggaggaggagtatgaaaacctgctgaaagcgtcctttgagaggatggatcacctgcgacagctgcagaacatcattcaggccacgtccagggagatcatgtggatcaatgactgcgaggaggaggagctgctgtacgactggagcgacaagaacaccaacatcgctcagaaacaggaggccttctccatacgcatgagtcaactggaagttaaagaaaaagagctcaataagctgaaacaagaaagtgaccaacttgtcctcaatcagcatccagcttcagacaaaattgaggcctatatggacactctgcagacgcagtggagttggattcttcagatcaccaagtgcattgatgttcatctgaaagaaaatgctgcctactttcagttttttgaagaggcgcagtctactgaagcatacctgaaggggctccaggactccatcaggaagaagtacccctgcgacaagaacatgcccctgcagcacctgctggaacagatcaaggagctggagaaagaacgagagaaaatccttgaatacaagcgtcaggtgcagaacttggtaaacaagtctaagaagattgtacagctgaagcctcgtaacccagactacagaagcaataaacccattattctcagagctctctgtgactacaaacaagatcagaaaatcgtgcataagggggatgagtgtatcctgaaggacaacaacgagcgcagcaagtggtacgtgacgggcccgggaggcgttgacatgcttgttccctctgtggggctgatcatccctcctccgaacccactggccgtggacctctcttgcaagattgagcagtactacgaagccatcttggctctgtggaaccagctctacatcaacatgaagagcctggtgtcctggcactactgcatgattgacatagagaagatcagggccatgacaatcgccaagctgaaaacaatgcggcaggaagattacatgaagacgatagccgaccttgagttacattaccaagagttcatcagaaatagccaaggctcagagatgtttggagatgatgacaagcggaaaatacagtctcagttcaccgatgcccagaagcattaccagaccctggtcattcagctccctggctatccccagcaccagacagtgaccacaactgaaatcactcatcatggaacctgccaagatgtcaaccataataaagtaattgaaaccaacagagaaaatgacaagcaagaaacatggatgctgatggagctgcagaagattcgcaggcagatagagcactgcgagggcaggatgactctcaaaaacctccctctagcagaccagggatcttctcaccacatcacagtgaaaattaacgagcttaagagtgtgcagaatgattcacaagcaattgctgaggttctcaaccagcttaaagatatgcttgccaacttcagaggttctgaaaagtactgctatttacagaatgaagtatttggactatttcagaaactggaaaatatcaatggtgttacagatggctacttaaatagcttatgcacagtaagggcactgctccaggctattctccaaacagaagacatgttaaaggtttatgaagccaggctcactgaggaggaaactgtctgcctggacctggataaagtggaagcttaccgctgtggactgaagaaaataaaaaatgacttgaacttgaagaagtcgttgttggccactatgaagacagaactacagaaagcccagcagatccactctcagacttcacagcagtatccactttatgatctggacttgggcaagttcggtgaaaaagtcacacagctgacagaccgctggcaaaggatagataaacagatcgactttaggttatgggacctggagaaacaaatcaagcaattgaggaattatcgtgataactatcaggctttctgcaagtggctctatgatgctaaacgccgccaggattccttagaatccatgaaatttggagattccaacacagtcatgcggtttttgaatgagcagaagaacttgcacagtgaaatatctggcaaacgagacaaatcagaggaagtacaaaaaattgctgaactttgcgccaattcaattaaggattatgagctccagctggcctcatacacctcaggactggaaactctgctgaacatacctatcaagaggaccatgattcagtccccttctggggtgattctgcaagaggctgcagatgttcatgctcggtacattgaactacttacaagatctggagactattacaggttcttaagtgagatgctgaagagtttggaagatctgaagctgaaaaataccaagatcgaagttttggaagaggagctcagactggcccgagatgccaactcggaaaactgtaataagaacaaattcctggatcagaacctgcagaaataccaggcagagtgttcccagttcaaagcgaagcttgcgagcctggaggagctgaagagacaggctgagctggatgggaagtcggctaagcaaaatctagacaagtgctacggccaaataaaagaactcaatgagaagatcacccgactgacttatgagattgaagatgaaaagagaagaagaaaatctgtggaagacagatttgaccaacagaagaatgactatgaccaactgcagaaagcaaggcaatgtgaaaaggagaaccttggttggcagaaattagagtctgagaaagccatcaaggagaaggagtacgagattgaaaggttgagggttctactgcaggaagaaggcacccggaagagagaatatgaaaatgagctggcaaaggtaagaaaccactataatgaggagatgagtaatttaaggaacaagtatgaaacagagattaacattacgaagaccaccatcaaggagatatccatgcaaaaagaggatgattccaaaaatcttagaaaccagcttgatagactttcaagggaaaatcgagatctgaaggatgaaattgtcaggctcaatgacagcatcttgcaggccactgagcagcgaaggcgagctgaagaaaacgcccttcagcaaaaggcctgtggctctgagataatgcagaagaagcagcatctggagatagaactgaagcaggtcatgcagcagcgctctgaggacaatgcccggcacaagcagtccctggaggaggctgccaagaccattcaggacaaaaataaggagatcgagagactcaaagctgagtttcaggaggaggccaagcgccgctgggaatatgaaaatgaactgagtaaggtaagaaacaattatgatgaggagatcattagcttaaaaaatcagtttgagaccgagatcaacatcaccaagaccaccatccaccagctcaccatgcagaaggaagaggataccagtggctaccgggctcagatagacaatctcacccgagaaaacaggagcttatctgaagaaataaagaggctgaagaacactctaacccagaccacagagaatctcaggagggtggaagaagacatccaacagcaaaaggccactggctctgaggtgtctcagaggaaacagcagctggaggttgagctgagacaagtcactcagatgcgaacagaggagagcgtaagatataagcaatctcttgatgatgctgccaaaaccatccaggataaaaacaaggagatagaaaggttaaaacaactgatcgacaaagaaacaaatgaccggaaatgcctggaagatgaaaacgcgagattacaaagggtccagtatgacctgcagaaagcaaacagtagtgcgacggagacaataaacaaactgaaggttcaggagcaagaactgacacgcctgaggatcgactatgaaagggtttcccaggagaggactgtgaaggaccaggatatcacgcggttccagaactctctgaaagagctgcagctgcagaagcagaaggtggaagaggagctgaatcggctgaagaggaccgcgtcagaagactcctgcaagaggaagaagctggaggaagagctggaaggcatgaggaggtcgctgaaggagcaagccatcaaaatcaccaacctgacccagcagctggagcaggcatccattgttaagaagaggagtgaggatgacctccggcagcagagggacgtgctggatggccacctgagggaaaagcagaggacccaggaagagctgaggaggctctcttctgaggtcgaggccctgaggcggcagttactccaggaacaggaaagtgtcaaacaagctcacttgaggaatgagcatttccagaaggcgatagaagataaaagcagaagcttaaatgaaagcaaaatagaaattgagaggctgcagtctctcacagagaacctgaccaaggagcacttgatgttagaagaagaactgcggaacctgaggctggagtacgatgacctgaggagaggacgaagcgaagcggacagtgataaaaatgcaaccatcttggaactaaggagccagctgcagatcagcaacaaccggaccctggaactgcaggggctgattaatgatttacagagagagagggaaaatttgagacaggaaattgagaaattccaaaagcaggctttagaggcatctaataggattcaggaatcaaagaatcagtgtactcaggtggtacaggaaagagagagccttctggtgaaaatcaaagtcctggagcaagacaaggcaaggctgcagaggctggaggatgagctgaatcgtgcaaaatcaactctagaggcagaaaccagggtgaaacagcgcctggagtgtgagaaacagcaaattcagaatgacctgaatcagtggaagactcaatattcccgcaaggaggaggctattaggaagatagaatcggaaagagaaaagagtgagagagagaagaacagtcttaggagtgagatcgaaagactccaagcagagatcaagagaattgaagagaggtgcaggcgtaagctggaggattctaccagggagacacagtcacagttagaaacagaacgctcccgatatcagagggagattgataaactcagacagcgcccatatgggtcccatcgagagacccagactgagtgtgagtggaccgttgacacctccaagctggtgtttgatgggctgaggaagaaggtgacagcaatgcagctctatgagtgtcagctgatcgacaaaacaaccttggacaaactattgaaggggaagaagtcagtggaagaagttgcttctgaaatccagccattccttcggggtgcaggatctatcgctggagcatctgcttctcctaaggaaaaatactctttggtagaggccaagagaaagaaattaatcagcccagaatccacagtcatgcttctggaggcccaggcagctacaggtggtataattgatccccatcggaatgagaagctgactgtcgacagtgccatagctcgggacctcattgacttcgatgaccgtcagcagatatatgcagcagaaaaagctatcactggttttgatgatccattttcaggcaagacagtatctgtttcagaagccatcaagaaaaatttgattgatagagaaaccggaatgcgcctgctggaagcccagattgcttcagggggtgtagtagaccctgtgaacagtgtctttttgccaaaagatgtcgccttggcccgggggctgattgatagagatttgtatcgatccctgaatgatccccgagatagtcagaaaaactttgtggatccagtcaccaaaaagaaggtcagttacgtgcagctgaaggaacggtgcagaatcgaaccacatactggtctgctcttgctttcagtacagaagagaagcatgtccttccaaggaatcagacaacctgtgaccgtcactgagctagtagattctggtatattgagaccgtccactgtcaatgaactggaatctggtcagatttcttatgacgaggttggtgagagaattaaggacttcctccagggttcaagctgcatagcaggcatatacaatgagaccacaaaacagaagcttggcatttatgaggccatgaaaattggcttagtccgacctggtactgctctggagttgctggaagcccaagcagctactggctttatagtggatcctgttagcaacttgaggttaccagtggaggaagcctacaagagaggtctggtgggcattgagttcaaagagaagctcctgtctgcagaacgagctgtcactgggtataatgatcctgaaacaggaaacatcatctctttgttccaagccatgaataaggaactcatcgaaaagggccacggtattcgcttattagaagcacagatcgcaaccggggggatcattgacccaaaggagagccatcgtttaccagttgacatagcatataagaggggctatttcaatgaggaactcagtgagattctctcagatccaagtgatgataccaaaggattttttgaccccaacactgaagaaaatcttacctatctgcaactaaaagaaagatgcattaaggatgaggaaacagggctctgtcttctgcctctgaaagaaaagaagaaacaggtgcagacatcacaaaagaataccctcaggaagcgtagagtggtcatagttgacccagaaaccaataaagaaatgtctgttcaggaggcctacaagaagggcctaattgattatgaaaccttcaaagaactgtgtgagcaggaatgtgaatgggaagaaataaccatcacgggatcagatggctccaccagggtggtcctggtagatagaaagacaggcagtcagtatgatattcaagatgctattgacaagggccttgttgacaggaagttctttgatcagtaccgatccggcagcctcagcctcactcaatttgctgacatgatctccttgaaaaatggtgtcggcaccagcagcagcatgggcagtggtgtcagcgatgatgtttttagcagctcccgacatgaatcagtaagtaagatttccaccatatccagcgtcaggaatttaaccataaggagcagctctttttcagacaccctggaagaatcgagccccattgcagccatctttgacacagaaaacctggagaaaatctccattacagaaggtatagagcggggcatcgttgacagcatcacgggtcagaggcttctggaggctcaggcctgcacaggtggcatcatccacccaaccacgggccagaagctgtcacttcaggacgcagtctcccagggtgtgattgaccaagacatggccaccaggctgaagcctgctcagaaagccttcataggcttcgagggtgtgaagggaaagaagaagatgtcagcagcagaggcagtgaaagaaaaatggctcccgtatgaggctggccagcgcttcctggagttccagtacctcacgggaggtcttgttgacccggaagtgcatgggaggataagcaccgaagaagccatccggaaggggttcatagatggccgcgccgcacagaggctgcaagacaccagcagctatgccaaaatcctgacctgccccaaaaccaaattaaaaatatcctataaggatgccataaatcgctccatggtagaagatatcactgggctgcgccttctggaagccgcctccgtgtcgtccaagggcttacccagcccttacaacatgtcttcggctccggggtcccgctccggctcccgctcgggatctcgctccggatctcgctccgggtcccgcagtgggtcccggagaggaagctttgacgccacagggaattcttcctactcttattcctactcatttagcagtagttctattgggcactagtagtcagttgggagtggttgctataccttgacttcatttatatgaatttccactttattaaataatagaaaagaaaatcccggtgcttgcagtagagtgataggacattctatgcttacagaaaatatagccatgattgaaatcaaatagtaaaggctgttctggctttttatcttcttagctcatcttaaataagcagtacacttggatgcagtgcgtctgaagtgctaatcagttgtaacaatagcacaaatcgaacttaggatttgtttcttctcttctgtgtttcgatttttgatcaattctttaattttggaagcctataatacagttttctattcttggagataaaaattaaatggatcactgatattttagtcattctgcttctcatctaaatatttccatattctgtattaggagaaaattaccctcccagcaccagcccccctctcaaacccccaacccaaaaccaagcattttggaatgagtctcctttagtttcagagtgtggattgtataacccatatactcttcgatgtacttgtttggtttggtattaatttgactgtgcatgacagcggcaatcttttctttggtcaaagttttctgtttattttgcttgtcatattcgatgtactttaaggtgtctttatgaagtttgctattctggcaataaacttttagacttttgaagtgtttgtgttttaatttaatatgtttataagcatgtataaacatttagcatatttttatcataggtctaaaaatatttgtttactaaatacctgtgaagaaataccattaaaaaactatttggttctgaattcttacta

SEQ ID NO: 308 - DNA, 1685 bp, Homo sapiens
ggagtcgaccgctcgggcagcgccaccgccacgagagcccgggacgcgggaaagaccgaaaggaagaggaagaggcaccggtggccatggggctggaggcggcgcgcgagctggagtgcgcggcgctgggcacgctgctgcgggatccgcgggaggcggaacgcacgctgctgctggactgccgccccttcctggccttctgccggcgccacgtgcgcgccgcgcggccagtgccttggaacgcgctgctgcggcgccgcgcgcgcggccctcctgccgccgttctcgcctgcctgctgcccgaccgcgcgctgcggacgcgcctggtccgcggggagctggcgcgggccgtggtgctggacgagggcagtgcctcggtggcggagctccggcccgacagcccggctcatgtgctgctggccgcgctgctgcacgagacccgcgcggggcccactgccgtgtacttcctgcgaggaggcttcgacggcttccagggctgctgtcccgatctgtgctctgaggcccccgcccctgcgctgccgccaacaggggacaaaaccagccgctccgactccagggctcctgtctacgaccagggtggccctgtggagatcttgccctacctgttcctgggcagctgcagtcactcgtcagacctgcaggggctgcaggcctgtggcatcacagccgtcctcaacgtgtccgccagctgccccaaccactttgagggccttttccgctacaagagtatccctgtggaggacaaccagatggtggagatcagtgcctggttccaggaggccataggcttcattgactgggtgaagaacagcggaggccgggtgctggtgcactgccaggcgggtatctcgcgctctgccaccatctgtctggcatacctcatgcagagtcgccgtgtgcggctggacgaggcctttgacttcgttaagcagcgccggggggtcatctcccccaacttcagtttcatggggcagctgctgcagtttgagacccaggtgctgtgtcactgaggtggtgcccctctgcctgcctgccccactgtgctggcaggagctgactgtggactggtgggctcccctctgggccagcacagtcccctcacctctggcagggctgctacctcctcagagtttcagaagcccccacatgggggctctaggaatgccggcatgctggtctttccgacctggtgctcttctgctgggggactgaggctggccctcattcggggtcgggaaccaagggtgtgtctgctctttccctccccatcctctggcagaaatcagctagacgctataccgtggactctccctggtccaccaccatgttgaagcccttggcagcctgagagctccaaggaacaagctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttatacagaacattcaggatatgtcaataaaatattgttatatttaaaaaacaa

SEQ ID NO: 309 - DNA, 1652 bp, Homo sapiens
gttattttcttttctcccccagctgccccagggttctggtttcccgaatcacttggcaaataaccagcaggtgggcagatgtcttttttgcgttcctacggacgcgtaggcaagttcgatgcgccggagtgaacagccagggtcccatctctcagccggctcccgggcggtgctagcagggaagagggacgcgccggcgaatgaaacactactagcccggaaagccgccctggaccttccacccgggcagcgagtctggcggcccctcgccgccgccccctccgaccagaacagactgcgctgcgagccccgggcttccgccgcagcgcgcagcaattggaggtgccagaggagaccagcagcagcacttgatttagctgggctgcgggaattccgacctgtacactttccagaagcctgatctctccaagtccgcgcccagggactcgagccccggcttccaggttgacccgagcgcgcccccttcgtgctctcggccgcgttcaccgcgcgaggcctccgggtcctgttaagcccgagcagcacaggccgctgcctcagcatccaccccgcagcccacgtgtggcaagccggggaaggggtggagtgaacggccggagaccacgtggagaaaggggccgctttggcccttccatctgggtgccgggagcccctaggccctccggccatggccgacagcggcgatgctggcagctccggcccctggtggaaatcgctcaccaacagcagaaagaaaagcaaggaagccgcagtgggggtgccgcctcccgcccagcccgctcccggggagcccacgccacctgcgccgcccagcccggactggaccagcagctcccgggagaaccagcaccccaatctcctcgggggcgccggcgagccccccaaaccagacaagttatacggggacaaatccggcagcagccgccgcaatttgaagatctcgcgctccggccgctttaaggagaagaggaaagtgcgcgccacgctgctcccggaggcgggcaggtccccggaggaggcaggctttcctggtgacccccacgaggacaagcagtagccccaatagcctgcgcgctccaggactgcctacccagcactaccccaaacccccagttccaaacccgagacttcaggcccgcccccttacgcgttgtctcattccaccaaattcagaatatttacacaatgccttcatgattttatttttctggaaattgaagtgtcaattgggttctcaatatttcatgactccaaggatgcattaaatatttatttgtggtaagagaagatacctgccgcggaggagggtggcataattatttttttttcaaaaagctattctggggccctggccccctggctcctgtcacagctcagcttgaactctgtagcctctcaaatgaagaaggtggctgttatttaggactctgtggaaagcaaatcacagtgctgtttttaatgcctgagaaatgcactttaggggtagacttataccttaagtgaaggagtgggggaggaagaagcattcttaagtagaagcattttaaaataaggcaggattgcttttaatgttaaactacaaaactgtacagcctattttagtgtggactattaaaacccttgcactgtaa

SEQ ID NO: 310 - DNA, 4030 bp, Homo sapiens
ggaaaaggcgccttgggagcgggcgctcggcggggcctcctcgggccccgggcgcggcgcggcgagtgggagcgagcgcgccaggaccacgcaggcgccctgctccggctggccctcggccggcgcgcggcgcgggagcagcccgcagcccgcctcccgcgcccccggcagccccctggcagcccgcagccgcccgtccggagcagcccctcggcagcccgcgcaggccgccggcccgggagagcgcgcggcggcggcggcggcgggacggccccgagcgcgccctcccgcctgcggccactcgcagccggcgctggccgggccggcgcgccccgcaggcggctagagcgcggcctcggcctcggcgcgggcttgccccgggccgtagcccgcgagaggcggcgcgggcggccgagggcactgacggcgtcgcgggacgctcccgggcggcggcgcagcggcagcggcagcggcagcggcagcgcagggggcggaggcagggggcgcccccagccaggatgctgcggttcctgcgccggacctttggccgccgctccatgcagcgctacgcgcggggcgcggcggggcgcggggccgccgggctgggggacgagcgcgatggggggccacgggggggcccggccgccgccgcctcctcctcggcgctgcccgccgcgcccgggggcagcgtgttcccggcgggcggcgggcccctgctcaccggcggcgcggccgtgcacatctccgccgccggcgccgccaaggccaccctctactgccgcgtcttcctgctcgacgggaccgaagtgagcgtggacctgccgaaacatgccaaaggccaggatttgtttgatcagattgtgtaccacttggaccttgtggaaacagattactttggcctccagttcctcgactctgcccaggttgcgcactggctggatcatgccaaacccataaaaaagcagatgaaaattggacctgcttatgctttacactttcgagttaaatactattcttcagaaccaaacaaccttcgtgaggagtttacaaggtacctgtttgttttacaactcaggcatgacattctttctggaaaattgaaatgcccttatgaaacagctgtggaattagctgctctctgtctacaagcggagcttggggagtgcgagcttccagaacacacaccagagcttgtgtctgagtttcggttcattccaaatcagacagaagcaatggaatttgatatcttccagagatggaaagagtgcaggggaaagagccctgcccaggcggaactctcctatctgaataaagcgaagtggctggaaatgtatggggtagacatgcacgttgtcaggggaagagatggctgtgaatattctcttggactgaccccgacaggcatattaatctttgaaggagctaacaaaataggcttattcttttggcctaaaattaccaaaatggattttaaaaagagcaaattgacactcgtggtggtcgaggatgatgatcagggacgtgagcaagagcacacgtttgtgttccggttagacagtgccaggacctgcaaacacctttggaagtgtgcagttgagcaccacgcattcttccgactgcggacgccaggaaacagcaaatccaatagatccgactttatcaggctgggctctcgcttcagattcagtgggcggacagaatatcaagctacacatggctccaggttacgaagaaccagcacctttgagaggaagcctagtaaacgttatccatcccggagacattcaacgttcaaagcaagcaacccagtgatagcagcccagctctgctctaaaacaaatccagaagtccataattaccagcctcaatatcatcctaatatccatcccagccagccccggtggcatcctcactctccaaatgtcaggccatcctttcaggatgacaggtcgcattggaaagcatcggccagtggagatgacagccattttgattatgtccacgaccagaaccagaagaacttaggagggatgcaaagtatgatgtatcgagataaactcatgactgcactttgagagactgaagcatctctcttccattcaccttcatagtttcattgcattccatgaaaagtgtcttggcctcagatggatggatgtgtttggacgagtgtctttaaggagtagtcctgaaaggtgtttttggtgtccatgtaaatatttgaagataaaaccactatagcttgtcataatttactgttgactgcattctcattaaaatgaaggtaaaggctcaggaatcatattgatgttctgattttaaaattggagtcaaagtctatgtttatcattttactatgttcctgatgttctttgttatttaattaatgggagcaaataaaaccagaagagcttgggaagattgctcagcatatattcctgtcgtagaagttgagattgctagggtccagtttccctagtgtggcctggacgagtcatttccccttcattgacctcattttccccatctgaaaagagagggttggactaagtgatctccaaggtcctttccaactctaaaattctgcaatttgttaacatttcattttgtttaggttgaggacatacattcaaactaattttatcacaaggaaaactgcaatacccacttccttgacagagttactcctttcagaagctaaataaagtatataacttattagatgttatatagatacagggggactttgaatttcacatcttaaagcagttgagctactttgaatttaagcagtcgtactaatcttaaattgcatagcatttgttttgatcgaatttgctgctcaagtatgggaataatttttaatgtcttaatgattggtgctgctaacttgcgtgatttcagaagacataattgtgaatacacactgtcagaattgggggattggtttttaccctagacttcactcttaaaaagcaacgtgcaatcaagatcatttatggctcaaatgaaagcatataaggttttcttgaagttgtgccaaagcattctgtagagtaggatgagatggttgttgccctagtctgttggtagaaccagaaatcaatatgttgtcttttaggttaaagcttgtaccaaaatatttatttcccccatttcaagccctgagtcaaacatttttttctcttaataatagacctgaaatgttttattagtatttctgtgaaatcagttgattcttgtgccatttttgtatatgtaattgtaattttgcccatgttaggccctctaaaaaatgtttgacatcctttgagatattttattactaaaatctgatcttttttggctactgcaaaaatctattcagcaagaaggtatcagctgcataccttgcacagtggagctgactacctataaactctccctaaggcatttgtttacaggtgtattccattttagcagacgttctgatgctcagtgtatgtgctgcatacaaataaatgtgttctgaatcttttcatcttattgatagcatttttacaaatgtgtttccaaggaataaagattattcttgctttttttttgactccatcttcattttttttaaattgattcttgttgctatgcagaagtctcatttgtgaatgaccttggtaacagaacagttggcttttggaagtctgaaggtgagcattcagttaggtgggtggagcaagatcatcctagaatgaggctgctcttggcaagagtggatcttataggcacagcagctgatgcctttcttcatctggggcaactctggtgaaggttgtcctgcctgtcacaggtgctgagtagagagaagtggtggcagtgggatttcctcagtaatagtcctgtaaaggtacgtgtttgtcctggctacttgtgctcttcctggcaggaaggcatccaaacccttatctgtgggctcctggaaattgtgtatgccatataataccctctaataaatacctctctgcttaaagtaaaaaaaaaaaaaaaaaaaaaa

SEQ ID NO: 311 - DNA, 7065 bp, Homo sapiens
agacacacactcaaacacacacacactcgctctcgcacactcggtgacacgcccgcgcgcgcgctcacccacacgcccggccgccggcgccctcccagctggtccaccccggcggggcccgcgcccccggcccgcccgcctggcaccgcgccccggggctggggccgagcgaggagcccgcgaggcggcgagagggcgagcgccaggcaggccggcccggggcccccgccccccgcgcccccgcccgatggggaacgctccgtcccaagatccggagcggagcagcccccccatgctgtctgcggacgatgcggagtacccgcgggagtaccggaccctggggggcgggggcggcgggggcagcgggggccggcgcttctccaacgtggggctggtgcacacgtccgagcggcggcacacggtgatcgcggcccagagtctggaggcgctcagcgggctccagaaggcggacgccgaccgcaagcgtgatgccttcatggaccacctgaagagcaagtacccacagcacgccctggccctgcgaggccagcaggacaggatgcgagagcagccaaactactggagtttcaagacccgcagctcacgccacactcagggagcccagcccgggctggcagaccaggcggcaaagctgtcctacgcctccgccgagtcgctggagaccatgtcggaggccgagctgcccctgggcttcagcaggatgaaccgcttccgacagagcctgcctctctcccgctcggccagccagaccaagctgcgctccccaggggtgctgttcctgcagttcggggaggagactcggcgcgtgcacatcacgcacgaggtcagcagcctggacacgctgcacgcactcatcgcgcacatgttcccgcagaagctcaccatgggcatgcttaagtcgcccaataccgccatcctcatcaaagacgaggctcgcaacgtcttctacgagctggaggacgtccgggacatccaggaccgcagtattatcaagatctacagaaaggagcccctctacgctgccttccctggctcacatctcaccaacggggacctccggagagagatggtgtacgcatcgcgggagtcctcgcccacgcggcgcctcaacaacctgtcaccagcgccgcacctggcatccggctcgccgccgcccgggctgccgtcggggctgccgtccgggctgcagtccggttcgccgtcgcgttcgcgcctatcgtacgccggggggcgcccgccttcgtacgccggcagcccggtgcaccacgcggccgagaggctgggaggcgccccggccgcccagggcgtcagccccagccccagcgccatcctggagcggcgcgacgtgaagccggacgaggacctggcgagcaaggcgggcggcatggtgctggtgaaaggcgagggcctctatgctgacccctacgggctgctgcacgagggccgtctgagcctggccgcggccgccggcgacccgttcgcctacccgggcgccggcggcctctacaagcgcggctcggtgcgctcgctcagcacctactcggccgccgcgctgcagtccgatctggaggactccctgtacaaggcggcgggcggcggcggcccgctgtacggcgacggctacggcttccgcctgccgccttcgtcaccgcagaagctggccgacgtggcagcaccccccggaggtcccccgccaccgcacagcccctactcggggccgcccagccgcggctcgccagtgcgccagtccttccgcaaggactcgggctcctcgtccgtctttgccgagagtcctggagggaagacccgcagcgcggggagcgcctcgacggccggagctcccccttcggagctcttccctgggcctggggaacgctcgctggttgggttcgggccgccagtgccagccaaggacacggagaccagggagcgcatggaggccatggagaagcagattgccagcctcacaggcctggtgcagagcgccttactgcgaggctctgagcctgagacccccagcgagaagattgaaggctccaatggagcagccaccccctcagcaccctgtgggtcaggcggccggagcagcggggccaccccggtgtccggcccgcccccgccctcggccagcagcacccccgcaggtcagcctaccgccgttagccggctgcagatgcagcttcacctgcgaggcctgcagaacagcgccagtgacttgcgcggccagctccagcagttgcgcaagctccagctacagaaccaggagtcggtgcgcgcgctgctgaagcgcacggaggcagagctgagcatgcgcgtgtcggaggcggcgcggcggcaggaggacccgctgcagcggcagcgcaccctggtggaagaggaacggctgcgctatctcaacgacgaggagcttattacccagcagctcaatgacctggagaaatcggtggagaagatccagagagacgtgtcccacaaccaccggctggtgcccggccctgagctggaggagaaggcactggtgctgaagcagctcggggagacgctgacagagctcaaggctcacttcccgggcctgcagagcaagatgcgggtggtgctgcgcgtggaggtggaggcggtgaagttcctgaaggaggagccccagcgcctggatgggctcctcaagcgctgccgcggggtcacggacacgctggcccagatccgaaggcaagtggatgagggtgtgtggccaccccccaacaatctcctgagtcagtcccccaagaaggtgacggcagagactgacttcaacaagagcgtggacttcgaaatgccaccccccagccccccgctgaacctgcatgagctgagcgggccagctgaaggagcctctcttacccccaaggggggcaaccccaccaaaggcctggacactcctggcaagagaagcgtggacaaagctgtgtctgttgaggctgcagagcgagactgggaggagaagcgggcagccctgacccagtacagtgccaaggacatcaaccggctgctggaagagacacaggcagagctgctcaaggccatccctgacctggactgtgccagcaaggcccatccaggcccggcccccactccagatcacaagccccccaaggccccccacggccagaaggcagccccccgaacggagcccagtgggaggaggggctcagatgagttgaccgtgccccgataccgcacagagaagccctccaagtcgcccccaccgccccctccccgccggagcttcccctcctcccatggcctgaccaccacacgtaccggagaggtggtggtcaccagcaagaaggactcggccttcatcaagaaggctgagtccgaggagctggaggtgcagaagccccaggtgaagctgcgccgggctgtgtctgaggtggcccgcccagcctccacaccacccatcatggcctcggccatcaaggacgaggatgacgaggatcgcatcatcgcagagctagagagtggcggaggcagtgtaccacccatgaaggtggtgactccgggggcctctcggctgaaggcggcccagggccaggcgggcagccccgacaaaagcaaacatggcaagcagagggccgagtacatgcggatccaggcccagcagcaggccactaaaccatctaaagagatgagcgggtcgaatgagacctcgagcccagtctcagaaaagccctcggcttccagaacctctatccctgtattgacttcctttggggcaaggaattcttccatctccttctagaagcccctcaccccgctgccccgcctgtccccctccctcactcctgccatttctcccctctcttccttcatctccaccccaccccaccctactctccagacgccctgaggggtgtgccctgaagaggagggtgcggccctcctcagcgacccctacccatcatctgttggtgtttttggttttgtttttttttttttttttaacaattaacttttaattatctttttttaaacagtaaaactaaaaaccaaacacaccaccttccttgatcccagctggcctctcgctggccgcacctgtcacatctctccttcttctctttcaccactctttcccccagtccatcctgaagctcctgcacccccttcccgccttcccctcacttcccaagaatactccaaacaaactctgaaccacggagacttggagcagtgggagacccctctcccgtttctcgataccttcctggaggaacgcggggacatcggaccaacccatacatcaagccagagagcggggcttagggagactggccttggagatgccccactccctgtctaagctccgacaagactgtgacttcctctgtggctgctctgcctcctcccactcacacccaagtgggcctggagtagagacggacaggctggagacgaggccggagtttgagaggcctcagggtgggtgtgaggccatggagtctgtatccctggggaggcgctggcctcctgggccttgccgtccagtggggagtggagggcagaggccctttggtctgctggctgtggagggtgggttgcacggacagccggatatcggggacactgccttgggagagggcggcccggacgggtatttggtacttttagtttcctgatttagcactttaaatggcattaacttattgaatggggatggggtgggcaagagtgaggggcctagaaaaccaggttttgtggcttgcagttgggggaagggtctggtttgagggaaatgggagggtcgagaggggcttgacggggagcactgaagacacctgggacccgcaggtggggtgacttgaacttcagtcatcctcttggcaatttgagggttttcccaggaaaggatgagacgtagtttttcaatggggctctggtgaccctggtgagatgtctgaaggtccctgaggcctgaccatccagccagcgcccctggcctgtggacgccctgcctgccctgcagaggcggttggcagtgccgcctggcttttggccgggtcctggggaggcagagagaggccaattttggttctcactcctggccccccagagggcacagtgaggagccggtagggagaggataggagaagaggaggaggaggagcggggtccccggccgcaggattcccacttggagcacaaagtgaagtaagcacaggggagggggactagaatcagtcccccatagcaagcacagaaaggaggagctgcgcagaaggcagagccccccagaccctggggcctggctggggaaggtccgcacctggggagagctgggagctgttgaaggtttggggggaggggaaacgggttgtgtttcttcatttctttttttgtttttgcctttgttggttcatccttgttttctagctttggatcatttttgtaccaaggcgagcaagcctttttgaaaaataacaaaagaggaaaaaaaaaatccctcctggaaaaaaaaaaaaaccctggaaaatagaaaaaaaaaaaaggacctcataaatgatgcaattacttttaattgcaggcaactctttacatttaagtgaagtgtcttaacattttatattgttttaaaaatatatttacatattatatatataatatacgtaatataaatatatataaatatttaaaaaagaaaaaaaaaagaaaaccacggcactctccctggccactgttttggcgggggaggggggctggggggcgggcacgtcggcctggcttctgtggtcccagtgaaatggtctggtttgatttggctgtacagagaccccctgacttgggaggggaggggggagtggtgccccctcctccctccactccattactctctgcttgctacttcgcttgcccccagctcccaccctcagccctgtgactggaatgtgtgccccaccgtcattgtcctgagttgaatgtccctttgtgggggaggtggggggggcagtgtccatccacgaaggggcagaaggagggagccacgtgccccgccccacccgctcgggtgaagcccagtgggatttgcatctttctttctctttggttcctgcacatttatgggctgggaggcatccgtgtggaattgcgtgcagcctgtgtgtgtgctggcacaagcccatgcactgtgtgtgcagacgcatggggcctgcacccacaggcatggccgagcacatgtgtgggggaaggcgtgggcacataggtgcatgtaacctgtttgggcattggcacgtgcctacctgcatgttagcgtgagaggagctttgtgtgtgagaacatgtgtaatgtgtgtgcagacatgccgagagccagagacttgtgtgtgggccacgtacatgtggatagagacgcatacatggaggtgcatgtaatctgtgtctccgagtgtgtgtgtgcaggtatgtgtgctggtgcagacccaagtgtgtgggtgtgcctctgtgtgcgtgtgttccatcatccctgcaccactggctccagatcccttcctgagcccccgtccccgctggccctctcacagcctgcagcacatcagtgcccccagctgcatgcgcctcgctgctctgtccatcagtgtgtgcttgaccaagagaaaactaagacgtctcgggggacccctgtacctggtcctctcagcccccgcccactgtgctgtgttactcgcatgggggatttcctgccccttccacaatatgctgtttccccaggagcctcaggcctgaggctctgagtggggtccccagggggccccccggggtgagccccggctccacaccctgccccatccaccctgtagggcccatgttggtgtagcagtgatggcttctgtggatattctgtgacctctgtcggtgtaacttgacaatttctaaatggaaaagggttgctgtgttttctctgtctctcttttttaatgtccttttttcttctcccccgctccctgctctctttccttttcagtttttctagccaagtgtttggggctttaataaaacttgtttctttttcctc

SEQ ID NO: 312 - DNA, 2953 bp, Homo sapiens
acgcccagctctgggtgctccagctgggccacagcctggtcctgccgctgcgcccgcccgccatggtgtcccgggaccaggctcacctgggccccaagtatgtgggcctctgggacttcaagtcccggacggacgaggagctgagcttccgcgcgggggacgtcttccacgtggccaggaaggaggagcagtggtggtgggccacgctgctggacgaggcgggtggggccgtggcccagggctatgtgccccacaactacctggccgagagggagacggtggagtcggaaccgtggttctttggctgcatctcccgctcggaagctgtgcgtcggctgcaggccgagggcaacgccacgggcgccttcctgatcagggtcagcgagaagccgagtgccgactacgtcctgtcggtgcgggacacgcaggctgtgcggcactacaagatctggcggcgtgccgggggccggctgcacctgaacgaggcggtgtccttcctcagcctgcccgagcttgtgaactaccacagggcccagagcctgtcccacggcctgcggctggccgcgccctgccggaagcacgagcctgagcccctgccccattgggatgactgggagaggccgagggaggagttcacgctctgcaggaagctggggtccggctactttggggaggtcttcgaggggctctggaaagaccgggtccaggtggccattaaggtgatttctcgagacaacctcctgcaccagcagatgctgcagtcggagatccaggccatgaagaagctgcggcacaaacacatcctggcgctgtacgccgtggtgtccgtgggggaccccgtgtacatcatcacggagctcatggccaagggcagcctgctggagctgctccgcgactctgatgagaaagtcctgcccgtttcggagctgctggacatcgcctggcaggtggctgagggcatgtgttacctggagtcgcagaattacatccaccgggacctggccgccaggaacatcctcgtcggggaaaacaccctctgcaaagttggggacttcgggttagccaggcttatcaaggaggacgtctacctctcccatgaccacaatatcccctacaagtggacggcccctgaagcgctctcccgaggccattactccaccaaatccgacgtctggtcctttgggattctcctgcatgagatgttcagcaggggtcaggtgccctacccaggcatgtccaaccatgaggccttcctgagggtggacgccggctaccgcatgccctgccctctggagtgcccgcccagcgtgcacaagctgatgctgacatgctggtgcagggaccccgagcagagaccctgcttcaaggccctgcgggagaggctctccagcttcaccagctacgagaacccgacctgagctgctgtggagcgggcatggccgggccctgctgaggaggggcctgggcagagggcctggacctgggatcaaggcccacgcgcttccctggggtttactgaggtgatgggtgcaggaaaggttcacaaatgtggagtgtctgcgtccaatacacgcgtgtgctcctctccttactccatcgtgtgtgccttgggtctcagctgctgacacgcagcctgctctggagcctgcagatgagatccgggagactgacacgaagccagcagaggtcagaggggactctgaccacagcccgctctctggctgtctgtctgcagtgcccggctgagggtgggaggcaaacacgccttgttcctgctcttcccagttcagcttggtgggagaaagtcattcgcgtggctcgggacgctcatgtaaatttggttttggtgctcaagggttctttcctcccaggggcaggtgtttctttcctgtttgtcttgtgtcttgagagcttggccttatgaccagtgagaactctctccctggtctctgccagcccaagcatcactgcccgaggcgccagctcagtttcaccgtccacgtccacaaggggcttttcccaccttcacctttgtcgctgggtcagtgctggaaagcgcccctcactcctgcgctgacaagggcccttctctactgtctgtggggtggttccgggctgggggggctgcctcctttgcacctgattttgaaggtgtctctttcatccatggttaagtcataaaaagcttattggttttggttttgactcacctgaaagtttttttggtttaaaagaagaataggcggggcacggtggctcatgcctgtaatcccagcactttgggaggctgaggcaggtggatcacgaggtcaggagatcgacaccatcctggctaacacggtgaaaccccgtctctactaaaaaatacaaaaaattagctgggtgtggtggtgggggtgggcgcctgtagtcccagctacgtgggaggctgaggcagcagactggtgtgaacccgggaggtggagcttgcagtgagccgagatcgcgccactgcactccagcctgggcgacagagcgagactccatctcaaaaaaaaaaaaaaaaaaaagaaagaaagaaaaataattttgggagtttctggaaaggtactaggatttctcaaaaggatttgtcttctgccttgtgaaagacagatgtcagactaatcaggcttatccgatgtgctacatgagatggaaagcgtgtgaaatagtaagtcacactaagtcttctggaggttctatttacgggtttggttttgatatgaatgttgcagaaactctataaaattcctagaaatctgatacgttatcctatgatatatatcctatctcacatgctattcctagaaatctggtgcaatgttatcagtcataattttggttattacattaaaatgctgcatgccacagaaataaccaagtttccttgccaaccgtgtcacgaatataataaactctcatcagatcctga

SEQ ID NO: 313 - DNA, 1547 bp, Homo sapiens
acagagcgctagtccttcggcgagcgagcaccttcgacgcggtccggggaccccctcgtcgctgtcctcccgacgcggacccgcgtgccccaggcctcgcgctgcccggccggctcctcgtgtcccactcccggcgcacgccctcccgcgagtcccgggcccctcccgcgcccctcttctcggcgcgcgcgcagcatggcgcccccgcaggtcctcgcgttcgggcttctgcttgccgcggcgacggcgacttttgccgcagctcaggaagaatgtgtctgtgaaaactacaagctggccgtaaactgctttgtgaataataatcgtcaatgccagtgtacttcagttggtgcacaaaatactgtcatttgctcaaagctggctgccaaatgtttggtgatgaaggcagaaatgaatggctcaaaacttgggagaagagcaaaacctgaaggggccctccagaacaatgatgggctttatgatcctgactgcgatgagagcgggctctttaaggccaagcagtgcaacggcacctccatgtgctggtgtgtgaacactgctggggtcagaagaacagacaaggacactgaaataacctgctctgagcgagtgagaacctactggatcatcattgaactaaaacacaaagcaagagaaaaaccttatgatagtaaaagtttgcggactgcacttcagaaggagatcacaacgcgttatcaactggatccaaaatttatcacgagtattttgtatgagaataatgttatcactattgatctggttcaaaattcttctcaaaaaactcagaatgatgtggacatagctgatgtggcttattattttgaaaaagatgttaaaggtgaatccttgtttcattctaagaaaatggacctgacagtaaatggggaacaactggatctggatcctggtcaaactttaatttattatgttgatgaaaaagcacctgaattctcaatgcagggtctaaaagctggtgttattgctgttattgtggttgtggtgatagcagttgttgctggaattgttgtgctggttatttccagaaagaagagaatggcaaagtatgagaaggctgagataaaggagatgggtgagatgcatagggaactcaatgcataactatataatttgaagattatagaagaagggaaatagcaaatggacacaaattacaaatgtgtgtgcgtgggacgaagacatctttgaaggtcatgagtttgttagtttaacatcatatatttgtaatagtgaaacctgtactcaaaatataagcagcttgaaactggctttaccaatcttgaaatttgaccacaagtgtcttatatatgcagatctaatgtaaaatccagaacttggactccatcgttaaaattatttatgtgtaacattcaaatgtgtgcattaaatatgcttccacagtaaaatctgaaaaactgatttgtgattgaaagctgcctttctatttacttgagtcttgtacatacatacttttttatgagctatgaaataaaacattttaaactgaa

SEQ ID NO: 314 - DNA, 6534 bp, Homo sapiens
gccagacttagctgaccagccagtgaggacgcccgctgcctcccacctgccctcctgccgtctttcgccagccaagcccagcctgagccagcacttgcctttacgaccatgttcaaggggctgagcaaaggctcccaggggaaggggtcccccaagggctcccccgccaaggggtcccccaaaggctcccccagcaggcacagccgggctgccacccaggagctggcccttctcatctcccgcatgcaagccaacgccgaccaggtggagcgggacatcctggagacgcagaagaggctgcagcaggaccggctgaacagtgagcagagccaggccctgcagcaccagcaggagacgggccgcagcctgaaggaggctgaggtgctgctcaaggacctcttcctggacgtggacaaggcccggcggctcaagcacccgcaggctgaggagattgagaaggacatcaagcagctgcacgagcgggtgacccaggagtgtgcggagtaccgtgccctgtacgagaagatggtgctgccccccgacgtgggacccagggtcgactgggcacgcgtgctggagcagaaacagaagcaggtctgcgcaggccagtacgggccgggcatggcggagctggagcaacagatcgccgagcacaacatcctgcagaaggagatcgacgcctatgggcagcagctgcggagcctcgtggggccggatgcagccaccatccggagccaataccgagacctactgaaggcggcgtcgtggcgcgggcagagcctgggcagcctgtacacgcacctccagggctgcacgcggcagctgagcgccctggctgagcagcagcgccgcatcctgcagcaggactggagcgacctcatggccgaccctgcgggcgtgcggcgggagtacgagcacttcaagcagcacgagctgctgagccaggagcagagcgtgaaccagctggaggacgacggcgagcgcatggtggagctgcggcaccccgcggtggggcccatccaggcccaccaggaggccctgaagatggagtggcagaacttcctgaacctgtgtatctgccaggagacccagctgcagcacgtggaggactaccgccggttccaggaagaggccgactcagtcagccagaccctggcgaagctcaactccaacttggatgccaagtacagccctgcacctgggggcccccctggcgcccccacagagctgctgcaacagctggaggcagaggaaaaacggctggccgtcaccgagagggccactggggacctgcagcggcgaagccgggatgtggcccctctgccacagcgaagaaacccccctcagcagcccctgcacgtggacagcatctgcgactgggactcaggagaagtgcagctgctgcagggtgagcggtataagctggtagataacactgacccgcacgcctgggtcgtgcagggccctggcggggagaccaagcgtgctcccgccgcctgcttctgcatcccagcaccagaccctgatgctgtggccagggcctcccggctggcctcagagctgcaggccctgaagcagaaattggccacagtccagagccgcctgaaggccagtgctgtggagtctcttcggcccagccagcagggtacccagggtggcccggggagaggtggctgtggggctagaaggagtagattccgacttccgactgctccatctggctcagacctggccaacccacaggcccagaagctcctgacacagatgacccggctggatggagacctgggacagatagagaggcaggtgctggcctgggcgcgggccccgctgagccgccccacacccttggaggacttggagggccgcatccacagccatgagggcacagcccagcgcctgcagagcctgggaacggagaaggagacagcccagaaggagtgcgaggcgtttctgtccacgcggcccgtgggccccgctgccctgcagctgcccgtagccctcaacagcgtgaagaacaagttcagtgacgtgcaggttctgtgcagcctctacggggagaaagccaaggctgccctggatctggagcggcagatccaggatgcggacagggtcatccgaggcttcgaggccaccctggtgcaggaggcccccatccctgctgaaccgggggctctgcaggagagggtcagcgagctgcagcgccagcggagggagctgctggaacagcagacctgcgtgctgcggctacaccgcgcgctgaaggcctcggagcacgcatgcgctgccctgcagaacaacttccaggagttctgccaagacctgcctcgccagcagcgccaggtgcgagccctcaccgaccgctaccacgccgtaggggaccagctggacctgcgggagaaggtggtgcaggatgccgccctcacctaccagcagttcaagaactgcaaggataacctgagctcctggctggagcacctgccccgcagccaggtgcggcccagcgacggccccagccagatcgcctacaagctgcaggcgcagaagaggctgacgcaggagatccagagccgagagcgggacagggccacagcatcccacctctcccaggccctgcaggcagcgctccaggactatgagctccaggcagacacctaccgctgctctttggagcccaccctggcagtgtcagcccccaagagaccccgagtggctcccctgcaagagagcatccaagcccaggagaagaaccttgcaaaggcctatactgaggttgcagcagcacagcagcagctgctccagcagctggagtttgctagaaaaatgctggagaagaaggagctcagtgaggacatccgaaggacccatgatgcaaagcagggctccgagagccctgcccaagcagggagagagtcagaggccctgaaggcccagctggaagaggagaggaagcgggtggcccgggtgcagcatgagctggaggcgcagaggagccaactgctgcagctgaggacccagcggcccttggagaggctggaggagaaggaagtggtagagttctaccgggacccccagctggagggcagcctgtccagggtgaaggcccaggtggaggaggagggcaagcggcgggctggcctgcaggcagacctggaagtggcagcccagaaggtcgtgcagctggaaagcaagaggaagaccatgcagcctcatctgctgaccaaggaggtcacccaggtggagagggaccccggcctggacagccaggcggcccagctcaggatccagatccagcagctccgcggggaggatgccgtcatctcggcccggctggaagggctgaagaaggagctactggcccttgagaagagggaggtggacgtgaaggagaaggtcgtggtgaaagaggtagtcaaggtggagaagaatctggaaatggtcaaggcagcccaggctctgaggctgcagatggaggaggatgctgcgcggaggaagcaggcggaggaggctgtggccaagctacaggctcgcatcgaagacctggagcgggctatcagctcggtggagcccaaggtcatcgtgaaggaggtgaagaaggtggagcaggacccagggctcctccaggagtcctccaggctgaggagcctcctcgaggaggagaggaccaagaacgcgacgctggccagggagctgagcgacctgcacagcaagtacagcgtggtggagaagcagaggcccaaagtgcagctccaggagcgcgtccacgagatcttccaggtggatccggagacagagcaggagatcactcggctcaaggccaagctgcaggagatggcgggcaagaggagcggtgtggagaaggaggtggagaagctgctgcccgacctggaggtcctgcgggcccagaagcccacggtggagtacaaggaggtgacccaggaggtggtgaggcatgagaggagccccgaggtgctgcgtgagatcgaccgcctgaaggctcagctcaacgagctcgtcaacagccacgggcgctcccaggagcagctcatccgcctgcagggtgagcgcgacgagtggaggcgcgagcgggccaaggtggagaccaagacggtgagcaaggaggtggtgcgccacgagaaggacccggtgctggagaaagaagcagagcggctccgccaggaggtgcgggaggcggcccagaagaggcgggccgcggaggacgcggtgtacgagctgcagagcaagcgcctgctgctggagaggaggaagcccgaggagaaggtggtggtgcaggaggtggtggtcacccagaaggacccgaagctgcgcgaggagcacagccggctgagcgggagcctggatgaggaggtgggccggcggcgccagctagagcttgaggtgcagcagctgcgggccggcgtggaggagcaggagggcctgctcagcttccaggaggaccgcagcaagaagctggccgtggagagggagctgcggcagctgaccttgaggatccaggagctcgagaagcggcctcccacggtgcaggagaagatcatcatggaggaagtggtcaagctggagaaggacccggacctggagaagtccacggaagccctgcggtgggacctggaccaggagaagacccaggtaaccgagctgaatcgggagtgcaagaacctgcaggtccagattgacgtcctccagaaagccaaatcgcaggagaagaccatctacaaggaagtgatccgggtgcagaaggaccgcgtcctggaagatgagcgggcccgcgtgtgggagatgctcaacagggagcgcacggcccggcaggcccgggaggaggaggcacggcgcctgcgggagcgcattgaccgggccgagacgctggggagaacctggtcccgggaggagtccgagctgcagagggcccgggaccaggccgaccaggagtgtgggcggctgcagcaggagctgcgggctctggagaggcagaagcagcagcagacactgcagctgcaggaggagtcgaagctgctcagccagaagacggagagcgagcgacagaaggcggcccagcggggccaggagctctcgcggctggaggcggccatcctccgcgagaaggaccagatctacgagaaggagcggacgctccgggacctccacgccaaggtgagccgggaggagctcagccaggagacccagacgcgagagaccaacctttccaccaagatctccatcctggaacccgagacggggaaggacatgtccccatacgaggcctacaagaggggcatcatcgacaggggccagtacttgcagctgcaggagctcgagtgtgactgggaggaggtcaccacctcggggccctgtggggaggagtctgtgctcctggaccgcaagagcgggaagcagtactccatcgaggccgccctccgctgccggcgcatctctaaggaggagtaccatctgtacaaggacggccacctgcccatctccgagtttgcgctgcttgtagctggggagaccaagccaagctcctcactctccatcggctctatcatctccaagtccccgctcgcctccccggccccccagagcaccagtttcttctctcccagcttctctctcgggctcggtgatgacagcttccctatcgccgggatctatgacacaaccacagacaacaagtgcagcatcaagacggccgtggccaagaacatgctggaccccatcactgggcagaagctactggaggcccaggcggccacagggggcatcgtggacctgctcagccgtgagcgctactctgtgcacaaggcgatggagaggggcctgatcgagaacacctccacacagaggctgcttaacgcccagaaggccttcaccggcatcgaggaccccgtcaccaagaagaggctctcggtgggcgaggccgtccagaagggctggatgccccgggagagcgtgctcccacacctgcaggtgcagcacctgaccggggggctcatcgaccccaagaggacaggccgcatccccatccagcaggccctcctctccgggatgatcagtgaagagctggcccagctcctgcaggacgagtccagctacgagaaggatttgacagaccccatctccaaggaacggctgagctacaaggaggccatgggccgctgccgcaaagaccccctgagcggcctgctgctcctgccagcggcactggaggggtaccgctgctaccgctccgcctcccccaccgtcccgcgctcccttcgctgacacgggccaaggagccagtggggaagtgcgtgtgttgggccaggtaggatacgtacacctcttgcctcagagcagcctcatcccaggcagtgggtcttccctctgtccaaccactgttttattattttactaacatggtgatgggctccctcccctaaccttggtgcctgatccatccccagaccaggacagcagccactcagttcttcctccacctccacccagtgatcccaataaacgaattctgtctccccgtgc

SEQ ID NO: 315 - DNA, 2463 bp, Homo sapiens
ctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgaccactgcctggtttgttttgtggactaggggatagagaatccagggttctctcatgaggagttaaacatatttcaagagcaacaggaaaaaaggtacatcaagccatttgaaaacaaaaatttattgcttctccttccaaagctttgtgaatttacaaaaaaaaggatgaaagtttacaaactgcttagttccaactaagcataagaggtgagaacgtacactgcagggccaccagcagcagctgtgcactgatgttaaaactggctcccccagacttgtagtgctgtcttcagggggctgcattccttacacgccacctcttgtgacataggtcattggtcaagccgctggaatgctacagaggtttttttggttttgagaggcttttttttgttttgccttcctactataaaagcgaaattttcagttcatttctgaaaaataaattggtcaataaattca

SEQ ID NO: 316 - DNA, 2442 bp, Homo sapiens
gttggctgccgaggctcggccggagcgtggagcccgcgccgctgccccaggaccgcgcccgcgcctttgtccgccgccgcccaccgcccgtcgcccgccgcccatggagcgcgccgcgccgtcgcgccgggtcccgcttccgctgctgctgctcggcggccttgcgctgctggcggccggagtggacgcggatgtcctcctggaggcctgctgtgcggacggacaccggatggccactcatcagaaggactgctcgctgccatatgctacggaatccaaagaatgcaggatggtgcaggagcagtgctgccacagccagctggaggagctgcactgtgccacgggcatcagcctggccaacgagcaggaccgctgtgccacgccccacggtgacaacgccagcctggaggccacatttgtgaagaggtgctgccattgctgtctgctggggagggcggcccaggcccagggccagagctgcgagtacagcctcatggttggctaccagtgtggacaggtcttccaggcatgctgtgtcaagagccaggagaccggagatttggatgtcgggggcctccaagaaacggataagatcattgaggttgaggaggaacaagaggacccatatctgaatgaccgctgccgaggaggcgggccctgcaagcagcagtgccgagacacgggtgacgaggtggtctgctcctgcttcgtgggctaccagctgctgtctgatggtgtctcctgtgaagatgtcaatgaatgcatcacgggcagccacagctgccggcttggagaatcctgcatcaacacagtgggctctttccgctgccagcgggacagcagctgcgggactggctatgagctcacagaggacaatagctgcaaagatattgacgagtgtgagagtggtattcataactgcctccccgattttatctgtcagaatactctgggatccttccgctgccgacccaagctacagtgcaagagtggctttatacaagatgctctaggcaactgtattgatatcaatgagtgtttgagtatcagtgccccgtgccctatcgggcatacatgcatcaacacagagggctcctacacgtgccagaagaacgtgcccaactgtggccgtggctaccatctcaacgaggagggaacgcgctgtgttgatgtggacgagtgcgcgccacctgctgagccctgtgggaagggacatcgctgcgtgaactctcccggcagtttccgctgcgaatgcaagacgggttactattttgacggcatcagcaggatgtgtgtcgatgtcaacgagtgccagcgctaccccgggcgcctgtgtggccacaagtgcgagaacacgctgggctcctacctctgcagctgttccgtgggcttccggctctctgtggatggcaggtcatgtgaagacatcaatgagtgcagcagcagcccctgtagccaggagtgtgccaacgtctacggctcctaccagtgttactgccggcgaggctaccagctcagcgatgtggatggagtcacctgtgaagacatcgacgagtgcgccctgcccaccgggggccacatctgctcctaccgctgcatcaacatccctggaagcttccagtgcagctgcccctcgtctggctacaggctggcccccaatggccgcaactgccaagacattgatgagtgtgtgactggcatccacaactgctccatcaacgagacctgcttcaacatccagggcggcttccgctgcctggccttcgagtgccctgagaactaccgccgctccgcagccacatgatcgtagggaactctgcatgaggccatcggtgcaggctggagaagagaaggcaagttggcaggagtggagaccacgggcatttgagccacttcctcatgtaacttaacttgtgccttcaggacctgctcaagcccgatcacgtatataccacttccatttgatgatggaatgctgctgttcatgaccaactttatggctagatgggtcagaaagcacccagttcatgataggcagttcaggtcatatggtgacttgatgacccagagtcaaacattcagtttccaccaaagcccagtaacaggccaagagctgtctctcaaaaggagagtagttatctgcagaagatggcagggccttgctccgaaagcctagagaccgccactgtgattcacctatgggggcctgccaaaggctgcagccagcatccttatctgccactgacacctcaagcaacattggatctgctgggtcatatggcccaagtggcagagcaacttgcacaacagcctggacctgtcatagagctttctcctgttctggaccccactcaaaactggcagcctttcaggtcactcgataaatgtgctggagtaacactcaaacgaggaatgtgttgcctccaaaatccaataggccca

SEQ ID NO: 317 - DNA, 10593 bp, Homo sapiens
gcactttcttctcagcgccgggcgggggcggcggcggcggcggctcctccgcgcccggcggacccctcggagctagcgcggcgggctcgggactgcgtgagcgccggacgcgaatttcccccgttgacaacttcttctcgcccggctcgtccccggcccgcgccgcgcccctcacgcggggacccaggacgccgcccctcagcgctgggcggccgctcacctcgggccggggggcgccgcgcctcccgcggagtggccgcgcccgctcggagccgtcccgcctgtcctgcccgcccgtccgtccggcgcggcgctcggggtggcggctgctcggcatggcccggggcgcccggccctcggcggccggtggcggcggcggcggcgcggagccccctgagcgcgcgggccccgggcggccgcggggatccccgcccggccgcgcccgcccctcgctggcgccgcgccccggcccggagccctcgcgaccccgggcggcgcccgagacctccggcggggacacggcgggcgcggggcggtgcggcgggcggcgggcggcaaagttggggccgggccgccgcggctggtgggcgctgctggcgctgcagctgcacttgctccgggcgctggcgcaagatgatgttgctccatattttaaaacggagccaggcctaccacagatccacctggaagggaaccgccttgttctcacctgccttgccgaagggagctggcctttggagttcaagtggatgcgcgatgacagtgagctcaccacctacagcagcgaatataagtacattattccatctttgcagaagctcgatgctgggttttaccgctgcgtggtgcgaaacagaatgggagcactcctgcaaagaaaatcagaagttcaagtcgcatatatgggaagtttcatggatacggaccagaggaaaacagtttctcaaggacgtgcagcgattctaaacctgctgcccatcaccagctaccccagacctcaagtgacttggtttagagaagggcacaagattattccaagcaacagaatagccatcacattggagaatcagctggtgatcctcgccaccacaaccagtgatgccggggcatactacgtgcaggccgtgaatgagaaaaatggagaaaacaagacaagcccattcattcatttgagcatagcaagagatgttggcacacctgaaaccatggccccaaccattgtggttcccccgggcaacagaagtgtggtggctggatccagtgagaccaccttggaatgtatagccagtgccaggcctgtggaggacctgagtgtgacctggaagaggaatggagtgagaatcaccagtggcctccacagctttggaagacgcctcaccatcagcaacccgacgtccgcggacaccgggccatacgtctgcgaggcggcgctgccggggagcgcttttgaaccggccagggcgacggcctttcttttcatcatagagccaccatattttactgctgagcccgagagtcggatttcagctgaagtagaagaaactgtggacatcggatgtcaagccatgggggtcccccttcccaccctccagtggtacaaggatgccatctccatcagcaggctccagaatcctcgatacaaagtgctcgccagcggaggcctgcgcatccagaagctgcgtccagaggactccggaatcttccagtgcttcgccagcaatgaaggaggggagatccagacccacacctacctggatgtaaccaatatcgctccagtgttcacccagcggccagtggacaccacagttactgacgggatgacagccattctaaggtgtgaggtgtccggggctcccaaacccgccatcacctggaaaagagaaaaccacattctggccagtggctctgtccggattcctaggttcatgcttcttgaatcggggggtctacagatcgcgcccgtcttcatccaggatgccggcaactacacctgctatgcggccaacacagagggctccctgaatgcatcggccacgctcactgtgtggaatcggacgtccatcgtccaccctcctgaggaccacgtggtgattaaggggaccacggccacgctgcactgtggtgccacacatgacccccgggtttcactccgctacgtttggaagaaggacaacgtggccctgactccatcgagcacgtctaggatcgtggtggagaaggacgggtcccttctcatcagccagacgtggtcaggcgacatcggtgactacagctgcgagattgtttctgaaggagggaatgactccaggatggcccggctggaagtgattgaactgcctcattcacctcagaacctcctggtcagccctaattcttcccacagccacgccgtggtgctctcttgggtccggccctttgatggaaacagtcctattctttattacatcgtggagctctctgaaaacaactctccatggaaggtgcatctgtcaaacgttggccctgagatgacaggcgtcaccgtgagtggcctgactccggctcgtacctatcaattccgggtgtgcgcggtgaatgaagtgggcaggggccagtacagcgccgagacaagcaggttgatgctacctgaagaaccacccagtgctcccccgaaaaatatagtggccagtgggcggactaatcagtccattatggtccagtggcagccacccccagaaacagagcacaacggggtgttgcgtggatacatcctcaggtaccgcctggctggccttcccggagagtaccagcagcggaacatcaccagcccggaggtgaactactgcctggtgacagacctgatcatctggacacagtatgagatacaggtggcggcgtacaacggggccggtctgggcgtcttcagcagggcagtgaccgagtacaccttgcagggagtgcccaccgcgcccccgcagaacgtgcagacggaagccgtgaactccaccaccattcagttcctgtggaaccctccgcctcagcagtttatcaatggcatcaaccagggatacaagcttctggcatggccggcagatgcccccgaggctgtcactgtggtcactattgccccagatttccacggagtccaccatggacacataacgaacctgaagaagtttaccgcctacttcacttccgttctgtgcttcaccacccctggggacgggcctcccagcacacctcagctggtctggactcaggaagacaaaccaggagctgtgggacatctgagtttcacagagatcttggacacatctctcaaggtcagctggcaggagcccctggagaaaaatggcatcattactggctatcagatctcttgggaagtgtacggcaggaacgactctcgtctcacgcacaccctgaacagcacgacgcacgagtacaagatccaaggcctctcatctctcaccacctacaccatcgacgtggccgctgtgactgccgtgggcactggcctggtgacttcatccaccatttcttctggagtgcccccagaccttcctggtgccccatccaacctggtcatttccaacatcagccctcgctccgccacccttcagttccggccaggctatgacgggaaaacgtccatctccaggtggattgttgaggggcaggtgggagctatcggcgacgaggaggagtgggtcaccctctatgaagaggagaatgagcctgatgcccagatgctggagatcccaaacctcacaccctacactcactacagatttcgaatgaagcaagtgaacattgttgggccgagcccctacagtccgtcttcccgggtcatccagaccctgcaggccccacccgacgtggctccaaccagcgtcacggtccgtactgccagtgagaccagcctgcggcttcgctgggtgcccctgccggattctcagtacaacgggaaccccgagtccgtgggctacaggattaagtactggcgctcagacctccagtcctcagcagtggcccaagtcgtcagtgaccggctggagagagaattcaccatcgaggagctggaggagtggatggaatacgagctgcagatgcaggccttcaacgccgtcggggctgggccgtggagcgaggtggtgcggggccggacgcgggagtcagttccttcagccgcccctgagaacgtgtcagccgaggctgtcagctcgacccagattttactgacatggacatccgtgccggaacaggaccagaatgggctcatactgggctacaagatcctgttccgggccaaagacctggatcccgagcccaggagccacatcgtgcgagggaaccacacgcagtcggccctgctggcaggcctgcgcaagttcgtgctctacgagctccaggtgctggcgttcacccgcatcgggaacggggtccccagcacgcccctcatcctggagcgcaccaaagacgatgccccaggcccaccagtgaggctcgtgttccccgaagtgagactcacctccgtgcggatagtgtggcaacctccggaggagcccaacggcatcatcctggggtaccagattgcctaccgcctggccagcagcagcccccacaccttcaccaccgtggaggtcggcgccacagtgaggcagttcacagccaccgacctggccccggagtccgcatacatcttcaggctgtccgccaagacgaggcagggctggggggagccactggaggccaccgtcatcaccaccgagaagagagagcggccggcaccccccagagagctcctggtgccccaggcagaagtgaccgcacgcagcctccggctccagtgggtcccgggcagcgacggggcctcccccatccggtacttcaccatgcaggtgcgagagctgcctcggggtgagtggcagacctactcctcgtccatcagccatgaggcgacagcatgcgtcgttgacagactgaggcccttcacctcctacaagctgcgcctgaaagccaccaacgacattggggacagtgacttcagttcagagacagaggcggtgaccacgctgcaggatgttccaggagagcccccgggatctgtctcagcgacgccacacaccacgtcctctgtcctgatacagtggcagcctccgagggacgaaagcctgaatggccttcttcagggatacaggatctactacagggagctggagtatgaagccgggtcaggcactgaggccaagacgctcaaaaaccctatagctttacatgctgagctcacagcccaaagcagcttcaagacggtgaacagcagctccacatcgacgatgtgtgaactaacacatttaaagaagtaccggcgctatgaagtaataatgaccgcctataacatcatcggcgagagcccagccagcgcgcccgtggaggtctttgtcggcgaggctgccccggccatggccccgcagaacgtgcaggtgaccccactcacggccagccagctggaggtcacgtgggacccaccacccccggagagccagaatgggaacatccaaggctacaagatttactactgggaggcagacagccagaacgaaacggagaaaatgaaggtcctcttcctccccgagcccgtggtgaggctgaagaacctgaccagccataccaagtacctggtcagcatatcagccttcaacgccgccggagatggacctaagagtgacccccagcaggggcgcacccaccaggccgcccctggggcccccagctttctggcgttctcagaaataacctccaccacgctcaacgtgtcctggggcgagcctgcggcggccaacggcatcctgcagggctatcgggtggtgtacgagcccttggcccctgtacaaggggtgagcaaggtggtgaccgtggaagtgagagggaactggcagcgctggctgaaggtgcgggacctcaccaagggagtgacctatttcttccgtgtccaagcgcggaccatcacctacgggcccgagctccaagccaatatcacagccgggccagccgagggatccccgggctcgcctagagatgtcctggtcaccaagtccgcctctgaactgacgctgcagtggactgagggacactctggcgacacacctaccacgggctatgtgatcgaggcccggccctcagatgaaggcttatgggacatgtttgtgaaggacatcccgcggagcgccacatcctacaccctcagcctggataagctccggcaaggagtgacttacgagttccgggtggtggctgtgaatgaggcgggctacggggagcccagcaacccctccacggctgtgtcagctcaagtggaagccccattctacgaggagtggtggttcctcctggtgatggctctgtccagcctgatcgtcatcctgctggtggtgttcgccctcgtcctgcacgggcagaataagaagtataagaactgcagcacaggaaaggggatctccaccatggaggagtctgtgaccctggacaacggaggatttgctgccctggagctcagcagccgccacctcaatgtcaagagcaccttctccaagaagaacgggaccaggtccccaccccggcctagccccggcggcctgcactactcagacgaggacatctgcaacaagtacaacggcgccgtgctgaccgagagcgtgagcctcaaggagaagtcggcagatgcatcagaatctgaggccacggactctgactacgaggacgcgctgcccaagcactccttcgtgaaccactacatgagcgaccccacctactacaactcatggaagcgcagggcccagggccgcgcacctgcgccgcacaggtacgaggcggtggcgggctccgaggcgggcgcgcagctgcacccggtcatcaccacgcagagcgcgggcggcgtctacacccccgctggccccggcgcgcgaactccgctcaccggcttctcctccttcgtgtgagcaaagcgccgcgcctccctcagggcggaacggaggcaactttccggagtctatttttgttaagacaatcaactccaataactgagctgaagtttttgtttaaaaagaaaaaaatctgataagtgatgattttacctacttgtggacactagatttcaattaggaaggtttttttaaacggctttttgtaacttcgctgcaggaagcaggtttgtttctttttcttttctttttaagagaaggtgtatttcactggtgcaatggcttggcacctccggggcctgggaggacctcagacctccccagccctgggtttctccgtcttcaagaccaactaggaagggtcaagcggggagagggagtggagggtcaggtgagatctcagagctgccccggccggcccccgtctctttctacctcctcttccagagaaccagcggctcacacccttctcaacgcaggacatcctcggcggctcctggggtttgaagagcaaacgtttttccctgggctcagtgcgttttgtcccaacttcatctgtttctgaaatgttctcacttggcagtgtctagtcaaggagtcggctttcaggttcctgacggccaggcagggatgctaaggtgtggctcagccgtcactgtctgtgtcactgcagtggtgcggtcctcaggcttttctgcctgtctttcccccttccttctcacctgacagcgagggagagggaagcctcttagggctggaagccaccacgctggccctctccttccccgaacacagcacacggtcaactccgcgggacacgaggacacgggacggcgtctccagaattgcttgttacgtaggaagcgtgcattgttaaccagagtatttttaaaatctttttatctttttttaaactatgtcacatgaaatgaatgcgtctttgctgtctccaggtgcctttttattaattgttcagctttgtacatgggaaagatgaaaagcaacagtgtctgcaaataaagcaaaacagctctgagaacacacgctcccgactcgcctcgtgcacaccaggccgtcccctccctctgtcctggcttctgctggctgctcgcagcagccaccgcttctccaccactggcgctgctgctgccccctctcccagtccgaggccagcttttagccttaacaggttttttggaaatgtttcttttttttatttaaaattgtcattgtttggtttaaatttttcagctagatgaaaagagtatgaactactttggaaaacttaacagctcagagatggccatgcctccagcccctcacgtcatctttgcaacagacgactgggctgccatggtccacccctcagcccgggtcccgggtctggatggaacgggagcactgctggtgcccactggcgtgtgtgccccgggtccctgtaagtgccccctcaccagcagcagcgtgacacacacaagactcaagaccaccctgtcagtgccccccagtgcacggcaaacgggcaggtgccgttcccccagtgacctgagggtaggggacaactgagcagtatctgaccagtgccacccaggagccagtctcctggccacatgcagaaagtgtggcccctgcttacctagatgttttgtgcacctccatgggcagagggtgtggatattgcctggattctgtgctgtcagcgttgctgagtatggccccaggagaccaaggagagttttgtataggctggaaaaccccttttcagtctttccaaaattagagggtatggcaagtttccttttttctctcctcccttccttcccctccttcctttcctttacccctcctttccttccttcctcccttcctctcttctttcctccctccctccctccttccctcccttccttcctctctttcctccttccttccctcccttctttccctccctcccttcctctctcccctattccttcttccttttctcctcctttttctgagtggagggggaaatattctaaaccaaaaatcctagatgctctgcccaaagccacttctgcatgagaatcgcaacccacagttccccggatgagactcaccacagtggacagtgccacctccttcccctcggccccggagagggcgaagtgggcgggaagccaggatgtgagcactggaatttcttggaagagaagcgataaatggagaccatggccagcgctgctttctgtgcactctgatgactgctctctgcagccatgaggatgtggctttacatgccagggagagtgttgagacgtcttaggttgaggatgagcagattcgagatatgtttgttgctctcgggttttcgatacaacatcatgacacttctgtttcaagctcatgttttccgtctcccctccactcttagtaaaccttgatctgtacggagcggcctgtccgaggctacgccggcctcctggctgctgctggactgtgcttaggacagcgcccatgcctcggagggactctgtcccatgagaaccacctgtgcaaaggaacagagctggatgtttccaggtagattttggcctcccagagcaatgcggcatttgagaagcaacagttcctaactccttatcttcagggaaggaaaagaaaatcacagcctaggaagatggaggttggattttaatctcggttttaaaaagaggacaaacaaaatgtctctaagccaggctagatggaatgtgctcccgctctctcctgccgtgctgaaagtcatgccttgcggatgcctcatgacagcagtggctgagtctccccacccacccccaacgtggctcatttcagattgcttcggccccaccctgcaaggatgtggtcacggagtggccaggaggctccgtctgagccacagggatgggtgtgcagagctccctcctcctggggtgccagggcagagattccaggcaggtgagcccagagagagctgccaggccacaccccctcggcctcctgcacggccaccttctgggtgaatcggtccagcccaagcccctctccccagcctcgccttcagcctctctcccagcctgcttttataaggcgcacttcactcaatgctgtagccaaaaaacgaggggccccagggagaggggacccagatggccacacacggaacgcgcctccacagccccgggaggtggctcactctgtacaggtcttcggaggccgtgtttgtatctaactgtgactgggctgaagcatgatgtttgcctaatggttcgtagcatggtttttatttcttacgcattcttggcacacagtgtagctatcctcctgacgagcaacccgtctgcgtacctaagtgtggctccccgtgggtcagcgtcctggtagcatggatccagtctgaaaggtgaggacaacgtggaaactcatgagctgagcctgcccgctgggacacgtctccttcccgcgtcaccttctggtttagggagccgtcaggtccctaaacgttccctacaactttttctgaaattgtgcagaaaaacagatctcattaaaagaaaaaaagaaacaacttgtaggaagacagagaggtgctatgggtacaatttttaataaaaacattattttgttccttaaa

SEQ ID NO: 318 - DNA, 5396 bp, Homo sapiens
agaaatagggcagccgcggcggcggtggcacagcagcgggcagcggcggctcagggagctggagcctcaacagcctccagcgagcccgggacccgccgacagcccgagaaaccagccgaaggacgcggggcggggtcgccgccgccgccacggggtgctccctccctcccgcccaagtccggccacctggtcttcccctcggccccggccgtctcagactcatcaaaatgaaaccaggaggcttttggctgcatctcacactgctcggagcctccctgccggctgcgctgggatggatggacccaggaaccagcagaggcccggatgtgggtgtgggggagtcacaggcagaggagcccagaagctttgaagtcacaagaagagaagggctttccagccacaacgagctgctggcctcctgcgggaagaagttctgcagccgagggagccggtgcgtgctcagcaggaagacaggggagcccgaatgccagtgcctggaggcatgcaggcccagctacgtgcctgtgtgcggctctgatgggaggttttatgaaaaccactgtaagctccaccgtgctgcttgcctcctgggaaagaggatcaccgtcatccacagcaaggactgtttcctcaaaggtgacacgtgcaccatggccggctacgcccgcttgaagaatgtccttctggcactccagacccgtctgcagccactccaagaaggagacagcagacaagaccctgcctcccagaagcgcctcctggtggaatctctgttcagggacttagatgcagatggcaatggccacctcagcagctccgaactggctcagcatgtgctgaagaagcaggacctggatgaagacttacttggttgctcaccaggtgacctcctccgatttgacgattacaacagtgacagctccctgaccctccgcgagttctacatggccttccaagtggttcagctcagcctcgcccccgaggacagggtcagtgtgaccacagtgaccgtggggctgagcacagtgctgacctgcgccgtccatggagacctgaggccaccaatcatctggaagcgcaacgggctcaccctgaacttcctggacttggaagacatcaatgactttggagaggatgattccctgtacatcaccaaggtgaccaccatccacatgggcaattacacctgccatgcttccggccacgagcagctgttccagacccacgtcctgcaggtgaatgtgccgccagtcatccgtgtctatccagagagccaggcacaggagcctggagtggcagccagcctaagatgccatgctgagggcattcccatgcccagaatcacttggctgaaaaacggcgtggatgtctcaactcagatgtccaaacagctctcccttttagccaatgggagcgaactccacatcagcagtgttcggtatgaagacacaggggcatacacctgcattgccaaaaatgaagtgggtgtggatgaagatatctcctcgctcttcattgaagactcagctagaaagacccttgcaaacatcctgtggcgagaggaaggcctcagcgtgggaaacatgttctatgtcttctccgacgacggtatcatcgtcatccatcctgtggactgtgagatccagaggcacctcaaacccacggaaaagattttcatgagctatgaagaaatctgtcctcaaagagaaaaaaatgcaacccagccctgccagtgggtatctgcagtcaatgtccggaaccggtacatctatgtggcccagccagcactgagcagagtccttgtggtcgacatccaagcccagaaagtcctacagtccataggtgtggaccctctgccggctaagctgtcctatgacaagtcacatgaccaagtgtgggtcctgagctggggggacgtgcacaagtcccgaccaagtctccaggtgatcacagaagccagcaccggccagagccagcacctcatccgcacaccctttgcaggagtggatgatttcttcattcccccaacaaacctcatcatcaaccacatcaggtttggcttcatcttcaacaagtctgatcctgcagtccacaaggtggacctggaaacaatgatgcccctcaagaccatcggcctgcaccaccatggctgcgtgccccaggccatggcacacacccacctgggcggctacttcttcatccagtgccgacaggacagccccgcctctgctgcccgacagctgctcgttgacagtgtcacagactctgtgcttggccccaatggtgatgtaacaggcaccccacacacatcccccgacgggcgcttcatagtcagtgctgcagctgacagcccctggctgcacgtgcaggagatcacagtgcggggcgagatccagaccctgtatgacctgcaaataaactcgggcatctcagacttggccttccagcgctccttcactgaaagcaatcaatacaacatctacgcggctctgcacacggagccggacctgctgttcctggagctgtccacggggaaggtgggcatgctgaagaacttaaaggagccacccgcagggccagctcagccctgggggggtacccacagaatcatgagggacagtgggctgtttggacagtacctcctcacaccagcccgagagtcactgttcctcatcaatgggagacaaaacacgctgcggtgtgaggtgtcaggtataaagggggggaccacagtggtgtgggtgggtgaggtatgaagggcccagagcagagccctgggccaaggaacaccccctagtcctgacactgcagcctcaagcaggtacgctgtacatttttacagacaaaagcaaaaacctgtactcgctttgtggttcaacactggtctccttgcaagtttcctagtataaggtatgcgctgctaccaagattggggttttttcgttaggaagtatgatttatgccttgagctacgatgagaacatatgctgctgtgtaaagggatcatttctgtgccaagctgcacaccgagtgacctggggacatcatggaaccaagggatcctgctctccaagcagacacctctgtcagttgccttcacatagtcattgtcccttactgccagacccagccagactttgccctgacggagtggcccggaagcagaggccgaccaggagcaggggcctccctcccgaactgaaagcccatccgtcctcgcgtgggaccgcatcttctccctcgcagctgcttcttgcttttctttccatttgacttgctgtaagcctgagggagagccaacaagacttactgcatcttgggggatggggaaatcactcactttattttggaaatttttgattaaaaaaaaattttataatctcaaatgctagtaagcagaaagatgctctccgaggtccaactatatccttccctgccttaggccgagtctcgggggtggtcacaaccccacatcccacagccagaaagaacaatggtcatctgagaatactggccctgtcgactattgccaccctgcttctccaagagcagaccaggccacctcatccgtaaggactcggttctgtgttgggaccccaaaaaaccagaacaagttctgtgtgcctcctttcagcacagaagggagacatctcattagtcaggtctggtaccccagattcagggcagactgggcttgcctggcaaggtatgggtggcctccaggctcaatgcagaaaccccaaggacacgagtggggccaggtgagttcctgaagctataccttttcaaaacagattttgttttcctacctgtggcccatccactcctctctggtaccccatccccgcatcagcactgcagagagaacacatttcggcgagggttttcttacccacattccccaatcaatacacacacactgcagaacccagaacagaaggccacaggctggcactactgcattctccttatgtgtctcaggctgtggtgactctcacatgggcatcgaagaagtacaacccacatagccctctggagaccgcctagatcagagactcagcaaaaacaggctcgccttccctctcccacatatgagtggaacttacatgtgtcctggtttgaatgatcattttgcaagccacacgggttgggagaggtggtctcaccacagacgtctttgctaatttggccaccttcacctactgacatgaccaggattttcctttgccattaaggaatgaactctttcaaggagaggaaaccctagactctgtgtcactctcaacacacacagctcctttcactcctgcctgactgccaagccacctgcatcccccgccccagatctcatgagatcaatcacttgtatgtctcacgcaacttggtccaccaaacgcctgtcccctgtaactcctaggggtgcgcctagacaggtacgtctgttttttattttaaaagatatgctatgtagatataagttgaggaagctcacctcaaaagcctagaatgcagtttcacagtagctgggatgcatggatgacccatctcacccctttttttttcctgcctcaatatcttgatatgttatgtttactcccaatctcccatttttaccactaaaattctccaactttcataaacttttttttggaaaaatttccattgtatcagcccctgacagaaaaaggatctctgagcctaaaggaggaaaagtcccaccaactaccagaccagaacacgagcccctctgggcagcaggattcctaagtcaaagaccagtttgacccaaactggccttttaaaataatcaggagtgacagagtcaacttctgcagcacctgcttctcccccactgtcccttccatcttggaatgtgtctaaaaaagcatagctgccctttgctgtcctcagagtgcatttcctggagacggcaggcttaggtctcactgacagcatgccagacacaactgaatcgaagcaggcctgaagcctaggtcagggtttcaggagtccagccccaggaggcaaagtcaccaatgcagggaggtaaatgccttttggcaggaaaaccaatagagttggttgggtggggagtcaggggtgggaggagaaggaggaagaggaggaaggccagactggcctgccctttctcccatacttcaccccagcagaggttcatgggacacagttggaaagccactgggaggaaatgcctcactacaggggggcctcctgtagcaagcccagccggtaatcctcctaatgaacccacaaggtcaattcacaactgatatcttagctattaaagaagtactgactttaccaaaagaatcatcaagaaagctatttatataaaccccctcagtcattttgaaataaaattaattttacaaaaa

SEQ ID NO: 319 - DNA, 1578 bp, Homo sapiens
acaactttcagtttcattattttagcttcctgagattcagaggccaggaactgtgcagagatctgtggggattctcacaacttccatttctggtgaacagctgaggtcagagaggagttggtccaggcgcaatgttcagcgtatttgaggaaatcacaagaattgtagttaaggagatggatgctggaggggatatgattgccgttagaagccttgttgatgctgatagattccgctgcttccatctggtgggggagaagagaactttctttggatgccggcactacacaacaggcctcaccctgatggacattctggacacagatggggacaagtggttagatgaactggattctgggctccaaggtcaaaaggctgagtttcaaattctggataatgtagactcaacgggagagttgatagtgagattacccaaagaaataacaatttcaggcagtttccagggcttccaccatcagaaaatcaagatatcggagaaccggatatcccagcagtatctggctacccttgaaaacaggaagctgaagagggaactacccttttcattccgatcaattaatacgagagaaaacctgtatctggtgacagaaactctggagacggtaaaggaggaaaccctgaaaagcgaccggcaatataaattttggagccagatctctcagggccatctcagctataaacacaagggccaaagggaagtgaccatccccccaaatcgggtcctgagctatcgagtaaagcagcttgtcttccccaacaaggagacgatgaagaaggatggtgcttcatcctgtttaggaaagtctttgggttcggaggattccagaaacatgaaggagaagttggaggacatggagagtgtcctcaaggacctgacagaggagaagagaaaagatgtgctaaactccctcgctaagtgcctcggcaaggaggatattcggcaggatctagagcaaagagtatctgaggtcctgatttccggggagctacacatggaggacccagacaagcctctcctaagcagcctttttaatgctgctggggtcttggtagaagcgcgtgcaaaagccattctggacttcctggatgccctgctagagctgtctgaagagcagcagtttgtggctgaggccctggagaaggggacccttcctctgttgaaggaccaggtgaaatctgtcatggagcagaactgggatgagctggccagcagtcctcctgacatggactatgaccctgaggcacgaattctctgtgcgctgtatgttgttgtctctatcctgctggagctggctgaggggcctacctctgtctcttcctaactacaaaagccctttctccccacaagcctctgggttttccctttaccagtctgtcctcactgccatcgccactaccatcctgtcaccagtgggacctctttaaaacaagcagccaaccattctttgatgtatcccattcgctccatgttaacatccaaaaccagcctggatttcatacatggacttctgattaaaagtggcaggttgtgcatgttaaaaaaaaaaaaaaaaaaaa

SEQ ID NO: 320 - DNA, 1683 bp, Homo sapiens
agtcgacccaagggtggagaagagggaaggcgaaggacgcgcgttcccgggctcgtgaccgccagcggcccggggaacccgctcccagacagactcggagagatggcaggcggaagacaccggcgcgtcgtgggcaccctccacctgctgctgctggtggccgccctgccctgggcatccaggggggtcagtccgagtgcctcagcctggccagaggagaagaattaccaccagccagccattttgaattcatcggctcttcggcaaattgcagaaggcaccagtatctctgaaatgtggcaaaatgacttacagccattgctgatagagcgatacccgggatcccctggaagctatgctgctcgtcagcacatcatgcagcgaattcagaggcttcaggctgactgggtcttggaaatagacaccttcttgagtcagacaccctatgggtaccggtctttctcaaatatcatcagcaccctcaatcccactgctaaacgacatttggtcctcgcctgccactatgactccaagtatttttcccactggaacaacagagtgtttgtaggagccactgattcagccgtgccatgtgcaatgatgttggaacttgctcgtgccttagacaagaaactcctttccttaaagactgtttcagactccaagccagatttgtcactccagctgatcttctttgatggtgaagaggcttttcttcactggtctcctcaagattctctctatgggtctcgacacttagctgcaaagatggcatcgaccccgcacccacctggagcgagaggcaccagccaactgcatggcatggatttattggtcttattggatttgattggagctccaaacccaacgtttcccaatttttttccaaactcagccaggtggttcgaaagacttcaagcaattgaacatgaacttcatgaattgggtttgctcaaggatcactctttggaggggcggtatttccagaattacagttatggaggtgtgattcaggatgaccatattccatttttaagaagaggtgttccagttctgcatctgataccgtctcctttccctgaagtctggcacaccatggatgacaatgaagaaaatttggatgaatcaaccattgacaatctaaacaaaatcctacaagtctttgtgttggaatatcttcatttgtaatactctgatttagtttaggataattggttctagaattgaattcaaaagtcaaggcatcatttaaaataatctgatttcagacaaatgctgtgtggaaacatctatcctatagatcatcctattcttatgtgtctttggttatcagatcaattacagaataattgtgttgtgatattgtgtcctaaattgctcattaatttttatttacagattgaaaaagagggaccgtgtaaagaaaatggaaaataaatatctttcaaagactcttttagataaacacgatgaggcaaaatcaggttcattcattcaacgatagtttctcaacagtacttaaatagcggttggaaaacgtagccttcattttatgattttttcatatgtggaaatctattacatgtaatacaaaacaaacatgtagtttgaaggcggtcagatttctttgagaaatctttgtagagttaattttatggaaattaaaatcagaattaaatgcta

SEQ ID NO: 321 - DNA, 988 bp, Homo sapiens
gcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtgaccctctactatgaagcactgtgcggtggctgccgagccttcctgatccgggagctcttcccaacatggctgttggtcatggagatcctcaatgtcacgctggtgccctacggaaacgcacaggaacaaaatgtcagtggcaggtgggagttcaagtgccagcatggagaagaggagtgcaaattcaacaaggtggaggcctgcgtgttggatgaacttgacatggagctagccttcctgaccattgtctgcatggaagagtttgaggacatggagagaagtctgccactatgcctgcagctctacgccccagggctgtcgccagacactatcatggagtgtgcaatgggggaccgcggcatgcagctcatgcacgccaacgcccagcggacagatgctctccagccaccacacgagtatgtgccctgggtcaccgtcaatgggaaacccttggaagatcagacccagctccttacccttgtctgccagttgtaccagggcaagaagccggatgtctgcccttcctcaaccagctccctcaggagtgtttgcttcaagtgatggccggtgagctgcggagagctcatggaaggcgagtgggaacccggctgcctgcctttttttctgatccagaccctcggcacctgctacttaccaactggaaaattttatgcatcccatgaagcccagatacacaaaattccaccccatgatcaagaatcctgctccactaagaatggtgctaaagtaaaactagtttaataagc

SEQ ID NO: 322 - DNA, 668 bp, Homo sapiens
gaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctggggccaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtga

SEQ ID NO: 323 - DNA, 6747 bp, Homo sapiens
accggtcccgcctcccttgacgccccgccccgcccctcctccctgctctcttagaaagagccaatcgctccgtctcattggcggccccgactcgtccagctgggtcgcgttagagtgcccgccccactcctcccagccacagccccgccccacctcccccaggccaatcagtttggttcctctcccctaagccacgcccccgctacctcgctcctcctcccacccaatcccgtcggtctctccccccgtgtccccgcccctgcgtccccgcccctcccgccccgccccccgtccaatgctgagctcagtctgcgtctcgtccttccgcgggcgccagggggccagcaagcagcagccggcgccaccgccgcagccgcccgagtccccgccgccgccaccgctgccgccgcagcagcagcagcctgcgcagcccggccccgccgcgtccccggcgggccccccggcaccccgcgggcccggggaccggcgcgccgagccatgccccgggctgccggcggcggccatggggcggcacggcggcggcggtggcgacagcggcaagatcgtgatcaacgtgggcggcgtgcgccatgagacgtaccgctcgacgctgcgcaccctgccggggacgcggctggccggcctgacggagcccgaggcggcggcacgcttcgactacgacccgggcgccgacgagttcttctttgaccggcacccgggagtcttcgcgtacgtgctcaactactaccgcaccggcaagctgcactgcccagccgacgtgtgcgggcccctgtttgaggaggagctcggcttctggggcatcgacgagaccgacgtggaggcctgctgctggatgacctaccggcagcatcgcgacgctgaggaggcgctcgactccttcgaggcgcccgaccccgcgggcgccgccaacgccgccaacgccgcaggcgcccacgacggaggcctggacgacgaggcgggcgcgggcggcggcggcctggacggagcgggcggcgagctcaagcgcctctgcttccaggacgcgggcggcggcgccggggggccgccagggggcgcgggcggcgcgggcggcacatggtggcgccgctggcagccccgcgtgtgggcgctcttcgaggacccctactcgtcgcgggctgccaggtatgtggccttcgcctccctcttcttcatcctcatctccatcaccaccttctgcctggaaacccatgagggcttcatccatattagcaacaagacggtgacccaggcctccccgatccccggggcacctccggagaacatcaccaacgtggaggtggagacggagcccttcctgacctacgtggagggggtgtgcgtggtctggttcaccttcgagttcctcatgcgcatcaccttctgcccagacaaggtggagtttcttaaaagcagcctcaacatcatcgactgtgtggccatcctgcccttctatctcgaggtgggcctctcgggcctcagctccaaggccgccaaagacgtgctgggcttcctgcgggtggtccgcttcgtccgcatcctgcgcatcttcaagctgacccggcacttcgtggggctgcgcgtgctgggacacacgctccgcgccagcaccaacgagttcctgctgctcatcatcttcctggccctgggggtgctcatcttcgccaccatgatttactacgctgagcgcattggcgccgaccccgatgacatcctgggctccaaccacacctacttcaagaacatccccattggcttctggtgggctgtggtcaccatgacgaccctgggctatggagacatgtaccccaagacgtggtcggggatgctggtcggggcgctgtgtgccctggcgggggtgctgaccatcgccatgcctgtgcccgtcattgtcaacaactttggcatgtactattcgctggccatggccaagcagaagctgcccaagaagaagaacaaacacatcccccggcccccgcaaccgggctcgcccaactactgcaagcctgacccacccccgccacccccgccccacccgcaccacggcagcgggggcatcagcccgccgccacccatcaccccaccctccatgggggtgactgtggccggggcctacccagcggggccccacacgcaccccgggctgctcagggggggagcgggtgggctggggatcatggggctgcctcctctgccagcccccggcgagccttgcccgttggctcaggaggaggtgattgagatcaaccgggcagatcctcgccccaatggggatccggcagcagctgcgcttgcccacgaggactgcccagccattgaccagcctgccatgtccccggaagacaagagccccatcacgcctggaagccgtggccgctatagccgggaccgagcctgcttcctcctcaccgactatgccccttcccctgatggctccatccgaaaagccactggtgctcccccactgcccccccaagactggcgtaagccaggccccccaagcttcttgcccgacctcaacgccaacgccgcggcctggatatccccctagtggacgaaccccctccccccgggctcttgtcaccgcctgagacctcgcgagactttcggtcccccccgccccttccccccaggttagcaattgggaatggctgggagggggtgtccccaagacactgggcttcaaatctccccccaagccctccctcctacgatcaagacaccttttgtccagacagctcccttagcgttgcctggaaaagccacagagctccctgcgggggtgcagaaccctgcaggcagccccaggctttgcagaaaccacacacactgttgctggatcttgagtcccattagctgtgagatgcctgtgagagccttcccgcacccgtcagaagctcagagccttcttggaccctttaaagatgtccctctccccagccctccgcctcaccgccccccacccccgaccccgtccttagaatcttctggaggagcctccctccccccccacccccccccactgctcctggagttctcatcggattccccaagggcactgccagcttcgctccactcagcccccttgcagaccccaccccctgcctgctctctttccctacaactaggtcagcccccagccccgctacggcggccgcaccgttccctgccctctccgctggctgctcccacatgcattccacccagcccctccccacgcccctgccgcccaccatcccgccttgctgccccccaccttttgcctcaggtgaggggaccagtggagggggggaagggcggtggactgtggtgggaatggggcgggggaggctcggtgggcaccaacctgcctcctaatccggagtctctcccccctccccgatgtctccccctttctcatcgatgttgactgactccccgatttgttcactttctctctccatctccttggtccatctctgtccatctgtctcttgtcatccgtccttttgtgtctctgtctgcctgactctgtctgtcttgccttctctgtctctctgggtatctgttgtcctccccttccatttctttctctctctgtctctttctccctgccttgggtctctctgtctgacccttccctgcaccccatcttcgtgcttcccccctgtgtctgcacacctccccaccccccaggttacgagaaatcccgcagcctcagcagcatcgcgggcctgagcggggtgtccctgcgcctcgcgccccttgccaccccccctggctctccccgggccgcccgccgcgctcccccgaccctgccctccatcctttagcgctcccctcccccctgtggggggactcgggggtgaccgggaagaaggtcaaaggagctgggggtggggggtggggaaaagggtttttttaaaaaaaatcaaaaagtcattaataatatgcaaccgagatgacgatgccagcagacacccccgggcccctcacccccaacctgggcccccaggatggagagaggggccacagcccgtccccccaactcttccctccccaaaaaaagccttctcaggtctccacgagccataggacatccccctgccatcaacttgtgtaaataagtccaaattatgccagttacatcttggggcacctccccccacacactgcatgccttccctaacctggagcccccactccaagtccacctcagcaataagccgccaggggccgcatgcgcgggtttgaggggcaggcactctgggaagggggtggcacctcccgggggtcgggctggcctttaaggtctccagccttcccatccttcaccccaggaggacaaccaaccctgtgcgttgattaggagaaaacaaaccagaaactagaaacagtgtaggggaaggaggaacagttacccaagccccagatcggagttgagctcaggtggcgggagggcggggccgagttgagctcaggtggtgggagggcggggcgggctttggacctgctccctcagcctttaggagaattcctctggtgaatttcaccctctcatccgccccttcccccagggacctgctcgcctctattcttgctgcatggactcagacctcctatcccagaattcctgggatgatctggccctagcacacgaaattccccgactatctccctccattcccaggacatgagacctgcacccagaattctgagactgaccctggcacgccacatctcccaatccccacacactcctgcgacttaacctctgcacacagaggctccctgaaccaccctccctccccactcctgccaccccaaacacccccaccaaattccctgaactgcgtcccagcacttctcaaacctccaagacttgacccagctcttttcagctcaaattcagcctttgggatgctccaaatccttcccacaactgacatttcttggacacccccaaagcctcaggcctgttccgcacccatatccccaaagccctaacagacttgtccagcccaggttcccttgatgctagaacttccaagataggcgcaacctgtctgcaattccagggaaccagaccctccccaagcaccctctttgtcttacgcctaaccctgagtctcttccctgagatggtgccccaaaggtaccctcttcacagacaccagtgtttcccagagggttgtatttgtacctttggtggtgtgctaaggtttgaggcagtatgaggacaaacacttgttttaaaagttttgtctctaatacgcattttgtacagaagccgataagtgcaggcatcgctgcttggctaggacacggtttatttaggttaagagtgtttccatttaaagtagtccacagatgatcacagaggctgttcccgaagggaggaacactggagtatcagaagattgggaaccgacaacacccagctcggctgggatcccagccccccttccccagcggtcctcaccgcgtcacgctcgcgggtggaaaatcatttcccacctcctatcctggctcaaggatgcgctacctcccccaagcccagagaccacaccggtcccagactctttagcggaccccccttttggagccggggtcccacggaattagccacctccctccctctgctcccacggcctcaggaaccccccacccgagggtggatggggggcgtcactgagcacgattctcgatgcaacgattcctatgcaaggggcattttgagtcccccccatccttccctcggaccctaaaccctggtgaagcaggggtgaggggtggggcgggttttggtgggggcggggcaaagggctaggggctccagacaccagggtacggggtggggactgattatattgccaaagggttcaacttctttaacaagcccccccgtttcccctgaccttcacgaaagccgaaggaggcggggaaagggggtgagggtcttttccaaagggtactgacctcttcccaacgtctccccctgctcgccagtccgccacacgtacccagcttttgagttcagcttttcaaaataaccacaatcatgataaacttctacaaaacgtgattctcctcccctcccaccccatcccccaagtcaatagtgtgggattcggggagggagagagcgagctaaagggactctttccaagtccggctcccccttttccccccggccgccagggtgcctgcacctacacgcatgcgctgcatgacgcgccccccacacgcatgtcgcacccctcctgcgctccgggaacgcacggacacgggccagggggcggggcgattggggaggaatgaatggcggggggtcttcctgagctccgcggctcaccctccccaacacacacacacacacacacagagcaataagtttctctcactcaaatgtgggcggggcgggcctagcctgtcgctggtggggggagtggtgagggggcgctctcagggatgggggcggggttcggagacagtgtggggaggggaggtctgcaaatcgtccaactctggtgctaatggcgggtcttctcagcccacccgcagggcagggagggaggggtcggcgtggccccttccccaagcctcccccacgcccaccctgggtgcatgaaccgcccaatgcagaagctgccgcatgtcacccccctctccccaaagaaaaagtgtcatgcccccttcccacccaccctcactccccaccaaaataaacgtttccttttcatttaaaaa

SEQ ID NO: 324 - DNA, 2189 bp, Homo sapiens
gcactcggagcccggcggggaccgggaggcagagacggggcggccgtggctccgagggcgggagctgagccgggccccgggaccgaagtttggcggcggctccgggaggcagagcgggctccccgggcgacttccaggcccctctcgcgtcctcgccccggacccgtgggcagccggggggaacggaagccgcggccgggccaactccgaggcggggacgccgcgacgggaacttgaggcccgagagggatgtgaaggcccaaaatgaccctcttaccgggagacaattctgactacgactacagcgcgctgagctgcacctcggacgcctccttccacccggccttcctcccgcagcgccaggccatcaagggcgcgttctaccgccgggcgcagcggctgcggccgcaggatgagccccgccagggctgtcagcccgaggaccgccgccgtcggatcatcatcaacgtaggcggcatcaagtactcgctgccctggaccacgctggacgagttcccgctgacgcgcctgggccagctcaaggcctgcaccaacttcgacgacatcctcaacgtgtgcgatgactacgacgtcacctgcaacgagttcttcttcgaccgcaacccgggggccttcggcactatcctgaccttcctgcgcgcgggcaagctgcggctgctgcgcgagatgtgcgcgctgtccttccaggaggagctgctgtactggggcatcgcggaggaccacctggacggctgctgcaagcgccgctacctgcagaagattgaggagttcgcggagatggtggagcgggaggaagaggacgacgcgctggacagcgagggccgcgacagcgagggcccggccgagggcgagggccgcctggggcgctgcatgcggcgactgcgcgacatggtggagaggccgcactcggggctgcctggcaaggtgttcgcctgcctgtcggtgctcttcgtgaccgtcaccgccgtcaacctctccgtcagcaccttgcccagcctgagggaggaggaggagcagggccactgttcccagatgtgccacaacgtcttcatcgtggagtcggtgtgcgtgggctggttctccctggagttcctcctgcggctcattcaggcgcccagcaagttcgccttcctgcggagcccgctgacgctgatcgacctggtggccatcctgccctactacatcacgctgctggtggacggcgccgccgcaggccgtcgcaagcccggcgcgggcaacagctacctggacaaggtggggctggtgctgcgcgtgctgcgggcgctgcgcatcctgtacgtgatgcgcctggcgcgccactccctggggctgcagacgctggggctcacggcccgccgctgcacccgcgagttcgggctcctgctgctcttcctctgcgtggccatcgccctcttcgcgcccctgctctacgtcatcgagaacgagatggccgacagccccgagttcaccagcatccctgcctgctactggtgggctgtcatcaccatgacgacggtgggctatggcgacatggtccccaggagcaccccgggccaggtagtggccctgagcagcatcctgagcggcatcctgctcatggccttcccagtcacctccatcttccacaccttctcccgctcctacctggagctcaagcaggagcaagagagggtgatgttccggagggcgcagttcctcatcaaaaccaagtcgcagctgagcgtgtcccaggacagtgacatcttgttcggaagtgcctcctcggacaccagagacaataactgagcgcggaggacacgcctgccctgcctgccatctgtggcccgaagccattgccatccactgcagacgcctggagagggacaggccgcttccgagtgcagtcctggcgcagcaccgactcccacgcacccggggaaggacaccctcactcccacaccccgggaagaacactagaacatcagcagaggggccctgcccctccgcctgcagccgtgaaaggaagctgggtcatcagcccagccccgcccaccccagcccctatgtgtgtttccctcaataaggagatgccttgttcttttcaccatgcaaataacatgcccagcaaaaacttgctttatgggtctgcctggagaaaaaaaaaaaaaatacaaacagcagaaacagca

SEQ ID NO: 325 - DNA, 10651 bp, Homo sapiens
agttcctgatccggctggtgcccgctccagccgcggcaggttccagagctgagaggccacccccacgccgcgggcttccagcgcgtggagcaaggggagcggccccggcgccgcccatatccccggctgcgctagtcctggcgctgcaggtccgggaggcgcaggcggagagcggcggtgcccccgagcccctctgcggacggctcaggcgggaggaccccgcgcggctggatggcggcggccgcgcggcctcggggtcgggcactggggccagtactgccgccgacgccgctgctcctgctggtactgcgggtgctgccagcctgcggggcgaccgctcgggatcccggggccgcggccgggctcagccttcacccgacttacttcaacctggccgaggcggcgaggatttgggccaccgccacctgcggggagaggggacccggcgaggggaggccccagcccgagctctactgcaagttggtcgggggccccaccgccccaggcagcggccacaccatccagggccagttctgtgactattgcaattctgaagaccccaggaaagcacatcctgtcaccaatgccatcgatggatctgaacgttggtggcaaagccctcccctgtcctcaggcacacagtacaacagagtcaacctcaccttggatctggggcagctcttccatgtggcctatattttaatcaaatttgcaaattctcctcgccctgatctttgggtcttggaaagatctgtagactttggaagcacctactcaccatggcaatattttgctcattctaaagtagactgtttaaaagaatttgggcgggaggcaaatatggctgtcacccgggatgatgatgtactttgtgttactgaatattcccgtattgtacctttggaaaatggtgaggttgtggtgtccttgataaacggtcgtccaggtgcaaaaaattttactttctctcacaccctgagggagtttaccaaggcaacaaacatccgcttgcgttttcttagaaccaatacgcttcttggacacctcatctccaaagcccagcgagatccaactgtcactcggcggtattattacagcataaaggacatcagcattggtgggcagtgtgtttgcaatggccatgctgaagtgtgcaatataaacaatcctgaaaaactgtttcggtgtgaatgccagcaccacacctgtggggagacgtgtgatcgctgctgcacagggtacaatcagaggcgctggcggcccgccgcttgggagcagagccacgagtgtgaagcatgcaactgccacggccatgccagcaactgttactatgatccagatgttgagcggcagcaggcaagcttgaatacccagggcatctatgctggtggaggggtctgcattaactgtcagcacaacacagctggagtaaactgtgaacagtgtgctaagggctattaccgcccttatggggttccagtggatgcccctgatggctgcatcccctgcagctgtgaccctgagcatgcggatggctgtgaacagggttcaggccgctgtcactgcaagccaaatttccacggagacaactgtgagaagtgtgcaattggatactacaatttcccattttgcttgagaattcccatttttcctgtttctacaccaagttcagaagatccagtagctggagatataaaagggtgtgactgtaatctggaaggtgttctccctgaaatatgtgatgcccacggacggtgcctgtgccgccctggggttgagggccctcgatgtgatacctgccgctctggtttctactcattccctatttgccaagcctgctggtgttcagcccttggatcctaccagatgccctgcagctcagtgactggacagtgtgaatgtcggccaggagttacaggacagcggtgtgacaggtgtctctcaggagcttatgatttcccccactgccaaggttccagcagtgcttgtgacccagctggtaccatcaactccaatttggggtattgccaatgcaagcttcatgttgaaggtcctacttgtagccgctgcaaactgttatattggaatctggacaaagaaaaccccagtggatgttcagaatgcaagtgccataaggcgggaacagtgagtggaactggagagtgtaggcagggagatggtgactgtcactgcaagtcccatgtgggtggcgattcctgcgacacctgtgaagatggatattttgctttggaaaagagcaattactttgggtgtcaagggtgtcagtgtgacattggtggggcattgtcctccatgtgcagtgggccctcgggagtgtgccagtgccgagagcatgtcgtgggaaaggtgtgccagcggcctgaaaacaactactatttcccagatttgcatcatatgaagtatgagattgaagacggcagcacacctaatgggagagaccttcgatttggatttgatccgctggcatttcctgagtttagctggagaggatatgcccaaatgacctcagtacagaatgatgtaagaataacattgaatgtagggaagtcaagtggctccttgtttcgtgttattctgagatacgttaaccctggaactgaagcagtatctggccatataactatttatccatcctggggtgctgctcaaagcaaagagatcatcttcctgccgagtaaggagccagcctttgtcactgtccctggaaatggttttgcagacccattttcaatcacaccaggaatatgggttgcttgtattaaggcagaaggagtccttctggattacctggtgctgctccccagggactactatgaagcctctgtactgcagctgccagtcacagaaccatgtgcctacgcaggacctccccaagaaaattgcttactctaccagcatttgccagtgaccagattcccctgtaccctggcttgtgaggccagacacttcctgcttgatggggagccaagacccgtggcagtgaggcagcccacacctgcacaccctgtcatggtggacctcagcgggagagaggtggaattgcatctgcggctgcgcatcccacaggttggccactacgtggttgtggtcgagtattccacggaggcagctcagctgtttgtggttgatgtgaatgtgaagagctccgggtctgttctggcaggccaggtgaacatttacagctgcaactacagtgttctctgccggagtgctgtgattgatcacatgagccgcatcgccatgtatgagctattggcagatgcagacattcagctcaagggacacatggcccgattccttctgcatcaagtttgtatcatacctattgaagaattctcagctgagtatgtgagaccacaagtccactgcattgccagttatgggcgatttgtcaatcaaagtgccacctgtgtctccttggcccatgaaactcctccaacagcattaattttggatgttctaagtggcaggcctttccctcacctgccccagcagtcgtcaccttctgttgatgttcttcctggggtcaccttgaaggcaccgcagaatcaagtgaccctgagaggacgtgtaccacacctgggccgatacgtctttgtcatccatttttaccaagcagcgcacccgacgtttcccgcgcaggtgtcggtggatggcgggtggccacgggcaggctccttccatgcctctttttgcccccatgtgcttggctgccgggatcaagtgattgccgaaggccagattgagtttgacatctcagagcctgaagtggccgcaactgtgaaggttccagaaggaaagtccttggttttggtccgtgttctagtggtgcctgcagaaaactatgactaccaaatacttcacaaaaaatccatggacaagtcactcgagtttatcaccaattgtggaaaaaacagcttttaccttgacccccagacagcctccagattctgtaagaattccgccaggtccctggtggccttttaccacaagggcgccctgccttgtgagtgccaccccactggggccaccggccctcactgcagccctgagggtgggcagtgcccatgccagcccaacgtcatcgggcggcagtgcacccgctgtgcaacaggccactacggattcccacgctgcaagccgtgcagctgtggtcggcgcctttgtgaagagatgacggggcagtgccgctgccctccccgcacggtcaggccccagtgtgaggtgtgtgagacacactcattcagcttccaccccatggccggctgcgaaggctgcaactgttccaggaggggcaccatcgaggctgccatgccggagtgtgaccgggacagcgggcagtgcagatgcaagcccagaatcacagggcggcagtgtgaccgatgtgcttccgggttttaccgctttcctgagtgtgttccctgcaattgcaacagagatgggactgagccaggagtgtgtgacccagggaccggggcttgcctctgcaaggaaaatgtagaaggcacagagtgtaatgtgtgtcgagaaggctcattccatttggacccagccaatctcaagggttgtaccagctgtttctgttttggagtaaataatcaatgtcacagctcacataagcgaaggactaagtttgtggatatgctgggctggcacctggagacagcagacagagtggacatccctgtctctttcaacccaggcagcaacagtatggtggcggatctccaggagctgcccgcaaccatccacagcgcgtcctgggtcgcacccacctcctacctgggggacaaggtttcttcatatggtggttacctcacttaccaagccaagtcctttggcttgcctggcgacatggttcttctggaaaagaagccggatgtacagctcactggtcagcacatgtccatcatctatgaggagacaaacaccccacggccagaccggctgcatcatggacgagtgcacgtggtcgagggaaacttcagacatgccagcagccgtgccccagtgtctagggaggagctgatgacagtgctgtctagactggcagatgtgcgcatccaaggcctctacttcacagagactcaaaggctcaccctgagcgaggtggggctagaggaagcctctgacacaggaagtgggcgcatagcacttgctgtggaaatctgtgcctgcccccctgcctacgctggtgactcttgtcagggttgtagccctggatactatcgggatcataaaggcttgtataccggacggtgtgttccctgcaattgcaacggacattcaaatcaatgccaggatggctcaggcatatgtgttaactgtcagcacaacaccgcgggagagcactgtgaacgctgccaggagggctactatggcaacgccgtccacggatcctgcagggcctgcccatgtcctcacactaacagctttgccactggctgtgtggtgaatgggggagacgtgcggtgctcctgcaaagctgggtacacaggaacacagtgtgaaaggtgtgcaccgggatatttcgggaatccccagaaattcggaggtagctgccaaccatgcagttgtaacagcaatggccagctgggcagctgtcatcccctgactggagactgcataaaccaagaacccaaagatagcagccctgcagaagaatgtgatgattgcgacagctgtgtgatgaccctcctgaacgacctggccaccatgggcgagcagctccgcctggtcaagtctcagctgcagggcctgagtgccagcgcagggcttctggagcagatgaggcacatggagacccaggccaaggacctgaggaatcagttgctcaactaccgttctgccatttcaaatcatggatcaaaaatagaaggcctggaaagagaactgactgatttgaatcaagaatttgagactttgcaagaaaaggctcaagtaaattccagaaaagcacaaacattaaacaacaatgttaatcgggcaacacaaagcgcaaaagaactggatgtgaagattaaaaatgtcatccggaatgtgcacattcttttaaagcagatctctgggacagatggagagggaaacaacgtgccttcaggtgacttttccagagagtgggctgaagcccagcgcatgatgagggaactgcggaacaggaactttggaaagcacctcagagaagcagaagctgataaaagggagtcgcagctcttgctgaaccggataaggacctggcagaaaacccaccagggggagaacaatgggcttgctaacagtatccgggattctttaaatgaatacgaagccaaactcagtgaccttcgtgctcggctgcaggaggcagctgcccaagccaagcaggcaaatggcttgaaccaagaaaacgagagagctttgggagccattcagagacaagtgaaagaaataaattccctgcagagtgatttcaccaagtatctaaccactgcagactcatctttgttgcaaaccaacattgcgctgcagctgatggagaaaagccagaaggaatatgaaaaattagctgccagtttaaatgaagcaagacaagaactaagtgacaaagtaagagaactttccagatctgctggcaaaacatcccttgtggaggaggcagaaaagcacgcgcggtccttacaagagctggcaaagcagctggaagagatcaagagaaacgccagcggggatgagctggtgcgctgtgctgtggatgccgccaccgcctacgagaacatcctcaatgccatcaaagcggccgaggacgcagccaacagggctgccagtgcatctgaatctgccctccagacagtgataaaggaagatctgccaagaaaagctaaaaccctgagttccaacagtgataaactgttaaatgaagccaagatgacacaaaagaagctaaagcaagaagtcagtccagctctcaacaacctacagcaaaccctgaatattgtgacagttcagaaagaagtgatagacaccaatctcacaactctccgagatggtcttcatgggatacagagaggtgatattgatgctatgatcagtagtgcaaagagcatggtcagaaaggccaacgacatcacagatgaggttctggatgggctcaaccccatccagacagatgtggaaagaattaaggacacctatgggaggacacagaacgaagacttcaaaaaggctctgactgatgcagataactcggtgaataagttaaccaacaaactacctgatctttggcgcaagattgaaagtatcaaccaacagctgttgcccttgggaaacatctctgacaacatggacagaatacgagaactaattcagcaggccagagatgctgccagtaaggttgctgtccccatgaggttcaatggtaaatctggagtcgaagtccgactgccaaatgacctggaagatttgaaaggatatacatctctgtccttgtttctccaaaggcccaactcaagagaaaatgggggtactgagaatatgtttgtgatgtaccttggaaataaagatgcctcccgggactacatcggcatggcagttgtggatggccagctcacctgtgtctacaacctgggggaccgtgaggctgaactccaagtggaccagatcttgaccaagagtgagactaaggaggcagttatggatcgggtgaaatttcagagaatttatcagtttgcaaggcttaattacaccaaaggagccacatccagtaaaccagaaacacccggagtctatgacatggatggtagaaatagcaatacactccttaatttggatcctgaaaatgttgtattttatgttggaggttacccacctgattttaaacttcccagtcgactaagtttccctccatacaaaggttgtattgaattagatgacctcaatgaaaatgttctgagcttgtacaacttcaaaaaaacattcaatctcaacacaactgaagtggagccttgtagaaggaggaaggaagagtcagacaaaaattattttgaaggtacgggctatgctcgagttccaactcaaccacatgctcccatcccaacctttggacagacaattcagaccaccgtggatagaggcttgctgttctttgcagaaaacggggatcgcttcatatctctaaatatagaagatggcaagctcatggtgagatacaaactgaattcagagctaccaaaagagagaggagttggagacgccataaacaacggcagagaccattcgattcagatcaaaattggaaaactccaaaagcgtatgtggataaatgtggacgttcaaaacactataattgatggtgaagtatttgatttcagcacatattatctgggaggaattccaattgcaatcagggaaagatttaacatttctacgcctgctttccgaggctgcatgaaaaatttgaagaaaaccagtggtgtcgttagattgaatgatactgtgggagtaaccaaaaagtgctcggaagactggaagcttgtgcgatctgcctcattctccagaggaggacaattgagtttcactgatttgggcttaccacctactgaccacctccaggcctcatttggatttcagacctttcaacccagtggcatattattagatcatcagacatggacaaggaacctgcaggtcactctggaagatggttacattgaattgagcaccagcgatagcggcggcccaatttttaaatctccacagacgtatatggatggtttactgcattatgtatctgtaataagcgacaactctggactacggcttctcatcgatgaccagcttctgagaaatagcaaaaggctaaaacacatttcaagttcccggcagtctctgcgtctgggcgggagcaattttgagggttgtattagcaatgtttttgtccagaggttatcactgagtcctgaagtcctagatttgaccagtaactctctcaagagagatgtgtccctgggaggctgcagtttaaacaaaccaccttttctaatgttgcttaaaggttctaccaggtttaacaagaccaagacttttcgtatcaaccagctgttgcaggacacaccagtggcctccccaaggagcgtgaaggtgtggcaagatgcttgctcaccacttcccaagacccaggccaatcatggagccctccagtttggggacattcccaccagccacttgctattcaagcttcctcaggagctgctgaaacccaggtcacagtttgctgtggacatgcagacaacatcctccagaggactggtgtttcacacgggcactaagaactcctttatggctctttatctttcaaaaggacgtctggtctttgcactggggacagatgggaaaaaattgaggatcaaaagcaaggagaaatgcaatgatgggaaatggcacacggtggtgtttggccatgatggggaaaaggggcgcttggttgtggatggactgagggcccgggagggaagtttgcctggaaactccaccatcagcatcagagcgccagtttacctgggatcacctccatcagggaaaccaaagagcctccccacaaacagctttgtgggatgcctgaagaactttcagctggattcaaaacccttgtataccccttcttcaagcttcggggtgtcttcctgcttgggtggtcctttggagaaaggcatttatttctctgaagaaggaggtcatgtcgtcttggctcactctgtattgttggggccagaatttaagcttgttttcagcatccgcccaagaagtctcactgggatcctaatacacatcggaagtcagcccgggaagcacttatgtgtttacctggaggcaggaaaggtcacggcctctatggacagtggggcaggtgggacctcaacgtcggtcacaccaaagcagtctctgtgtgatggacagtggcactcggtggcagtcaccataaaacaacacatcctgcacctggaactggacacagacagtagctacacagctggacagatccccttcccacctgccagcactcaagagccactacaccttggaggtgctccagccaatttgacgacactgaggatccctgtgtggaaatcattctttggctgtctgaggaatattcatgtcaatcacatccctgtccctgtcactgaagccttggaagtccaggggcctgtcagtctgaatggttgtcctgaccagtaacccaagcctatttcacagcaaggaaattcaccttcaaaagcactgattacccaatgcacctccctccccagctcgagatcattcttcactcaggacacaaaccagacaggtttaatagcgaatctaattttgaattctgaccatggatacccatcactttggcattcagtgctacatgtgtattttatataaaaatcccatttcttgaagataaaaaaattgttattcaaattgttatgcacagaatgtttttggtaatattaatttccactaaaaaattaaatgtcttttaagaaacattcttttccacttgttaaaaaaattaaatatattttaaagcactttaagaatatgaaactttcatatatgttaaaggattataatttatggaattaaaaaatgcagtgtagtccttaaa

SEQ ID NO: 326 - DNA, 4133 bp, Homo sapiens
agcgcctcccaggcagccagcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccatatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactcaaaacaaa

SEQ ID NO: 327 - DNA, 2008 bp, Homo sapiens
acttagagccgagtgggacaaagcctggggctgggcgggggccatggcgctgccatcccgaatcctgctttggaaacttgtgcttctgcagagctctgctgttctcctgcactcagggtcctcggtacccgccgctgctggcagctccgtggtgtccgagtccgcggtgagctgggaggcgggcgcccgggcggtgctgcgctgccagagcccgcgcatggtgtggacccaggaccggctgcacgaccgccagcgcgtgctccactgggacctgcgcggccccgggggtggccccgcgcggcgcctgctggacttgtactcggcgggcgagcagcgcgtgtacgaggcgcgggaccgcggccgcctggagctctcggcctcggccttcgacgacggcaacttctcgctgctcatccgcgcggtggaggagacggacgcggggctgtacacctgcaacctgcaccatcactactgccacctctacgagagcctggccgtccgcctggaggtcaccgacggccccccggccacccccgcctactgggacggcgagaaggaggtgctggcggtggcgcgcggcgcacccgcgcttctgacctgcgtgaaccgcgggcacgtgtggaccgaccggcacgtggaggaggctcaacaggtggtgcactgggaccggcagccgcccggggtcccgcacgaccgcgcggaccgcctgctggacctctacgcgtcgggcgagcgccgcgcctacgggcccctttttctgcgcgaccgcgtggctgtgggcgcggatgcctttgagcgcggtgacttctcactgcgtatcgagccgctggaggtcgccgacgagggcacctactcctgccacctgcaccaccattactgtggcctgcacgaacgccgcgtcttccacctgacggtcgccgaaccccacgcggagccgcccccccggggctctccgggcaacggctccagccacagcggcgccccaggcccagaccccacactggcgcgcggccacaacgtcatcaatgtcatcgtccccgagagccgagcccacttcttccagcagctgggctacgtgctggccacgctgctgctcttcatcctgctactggtcactgtcctcctggccgcccgcaggcgccgcggaggctacgaatactcggaccagaagtcgggaaagtcaaaggggaaggatgttaacttggcggagttcgctgtggctgcaggggaccagatgctttacaggagtgaggacatccagctagcctcctctcctcccacagattacaaaaacaacatcctgaaggagagggcggagctggcccacagccccctgcctgccaagtacatcgacctagacaaagacccttctgggctctgcccgctgggggcctgaagacattcctggaggacactcccatcagaacctggcagccccaaaactggggtcagcctcagggcaggagtcccactcctccagggctctgctcgtccggggctgggagatgttcctggaggaggacactcccatcagaacttggcagccttgaagttggggtcagcctcggcaggagtcccactcctcctggggtgctgcctgccaccgagagctcccccacctgtaccaccatgtgggactccaggcaccatctgttctccccagggacctgctgacttgaatgccagcccttgctcctctgtgttgctttgggccacctggggctgcaccccctgccctttctctgccccatccctaccctagccttgctctcagccaccttgatagtcactgggctccctgtgacttctgaccctgacacccctcccttggactctgcctgggctggagtctagggctggggctacatttggcttctgtactggctgaggacaggggagggagtgaagttggtttggggtggcctgtgttgccactctcagcaccccacatttgcatctgctggtggacctgccaccatcacaataaagtccccatctgatttttaga

SEQ ID NO: 328 - DNA, 3379 bp, Homo sapiens
attccagatgcctgggccgactcgaagcccttataaggcgcggagacaccggctctggctgggccgcccgcctccacagccgccgcccagggttctcccgccactgccgcccgcacccccgcccccgcggggttaagatcacacacgcgcccacgccggcccgcggggcgtgcactttcgctgggttccgtccgccgcagcccaaacagttaactgaacggggaggggagggggcggggcttacccggggtcaccgccagggccctgctgggttccacgccacgttcctgtctccgcagggcgttcgatccctagagggaggagcctgtccaaacggacgctaacggcctacctccccctcaggtgctcttacagcctgttccaagtgtggcttaatccgtctccaccaccagatctttctccgtggattcctctgctaagaccgctgccatgccagtgacggtaacccgcaccaccatcacaaccaccacgacgtcatcttcgggcctggggtcccccatgatcgtggggtcccctcgggccctgacacagcccctgggtctccttcgcctgctgcagctggtgtctacctgcgtggccttctcgctggtggctagcgtgggcgcctggacggggtccatgggcaactggtccatgttcacctggtgcttctgcttctccgtgaccctgatcatcctcatcgtggagctgtgcgggctccaggcccgcttccccctgtcttggcgcaacttccccatcaccttcgcctgctatgcggccctcttctgcctctcggcctccatcatctaccccaccacctatgtccagttcctgtcccacggccgttcgcgggaccacgccatcgccgccaccttcttctcctgcatcgcgtgtgtggcttacgccaccgaagtggcctggacccgggcccggcccggcgagatcactggctatatggccaccgtacccgggctgctgaaggtgctggagaccttcgttgcctgcatcatcttcgcgttcatcagcgaccccaacctgtaccagcaccagccggccctggagtggtgcgtggcggtgtacgccatctgcttcatcctagcggccatcgccatcctgctgaacctgggggagtgcaccaacgtgctacccatccccttccccagcttcctgtcggggctggccttgctgtctgtcctcctctatgccaccgcccttgttctctggcccctctaccagttcgatgagaagtatggcggccagcctcggcgctcgagagatgtaagctgcagccgcagccatgcctactacgtgtgtgcctgggaccgccgactggctgtggccatcctgacggccatcaacctactggcgtatgtggctgacctggtgcactctgcccacctggtttttgtcaaggtctaagactctcccaagaggctcccgttccctctccaacctctttgttcttcttgcccgagttttctttatggagtacttctttcctccgcctttcctctgttttcctcttcctgtctcccctccctcccacctttttctttccttcccaattccttgcactctaaccagttcttggatgcatcttcttccttccctttcctcttgctgtttccttcctgtgttgttttgttgcccacatcctgttttcacccctgagctgtttctctttttcttttcttttttttttttttttttttttaagacggattctcactctgtggcccaggctggagtgcagtggtgcgatctcgactcactgcaacccccgcctcctgggttcaagcgattctcctgccccagcctcccaagtagctgggaggacaggtgtgagctgccgcacccagcctgtttctctttttccactcttcttttttctcatctcttttctgggttgcctgtcggctttcttatctgcctgttttgcaagcaccttctcctgtgtccttgggagccctgagacttctttctctccttgcctccacccacctccaaaggtgctgagctcacatccacaccccttgcagccgtccatgccacagccccccaaggggccccattgccaaagcatgcctgcccaccctcgctgtgccttagtcagtgtgtacgtgtgtgtgtgtgtgtgtgtgtgtgtgtgtgtttggggggtggggggtgggtagctggggattgggccctctttctcccagtggaggaaggtgtgcagtgtacttcccctttaaattaaaaaacatatatatatatatatttggaggtcagtaatttccaatgggcgggaggctttaagcaccgaccctgggtccctaggccccgcctggcactcagccttgccagagattggctccagaatttttgccaggcttacagaacacccactgcctagaggccatcttaaaggaagcaggggctggatgcctttcatcccaactattctctgtggtatcaaaaagaaaaaaaaaaaaaaagaaggagtcggggccgggcgtggtggctcacgcctgtaatcccagcactttgggagaccaagtcaggcaatcatctgaagtcaggagttcaagaccagcctggccaacatggtgaaagcatgtctctattaaaaatacaaaaattagccgggcgtggtggcgggcgcctgtaatcccaggtatttggggggactgagacaggagaatcccttcaacccgggaggtggaggttgcagtaagtcaagatggcaccactgtgctccagcctgggggacagagcgagactccatctcaaaaaaaaaaaggaatcggacgaagaaccacaggatgttgaagacaactgtctgaagtatttgtgagggacagcgatgtggccctctgtgttaagaataacgtgtcctgctttggcagagagaagaaaatagccactgcccgctttcaaggcaagatcgaccttttctgttttgttttgtttttctttctttttcctggccatgaggacaaaaattactgagtggcccttaaagagggaagtttgttttcagctgttctcttttgcccgtaggtgggagggtggggattgctgcgtcctagctagaggaatggctttgcttgaatgtgtagtgcacacgcacgggtgtttctgtgtgctagttgcttcttgctgctgcttcctgcttgtctgggactcacatacataacgtgatatatatatatatatatataaatgtataaatatatattttatttttttttaaatccctggagcttctggttcctatcagttcctgttgttaatcgtagaaccgttgtcccttcccccattcccgtatccatcatgttctttttcttttaaatatcaatataaaggtaaaagaaaaaaaaaaaaaaaaaaaaaaaaa

SEQ ID NO: 329 - DNA, 9583 bp, Homo sapiens
agaggcgcggcggcgcacgggccgtccgctctgacgcgagcgggtcctccctcctcgccggccctcgcctcctccccacacctgggaggggagtggtgcggcgcggcctcctcccccggcgctcgcaactcctgtccggccgtagctgcgccgccgcggcgggagtaaaggtcgcgccgccgggagcgagccggccgcggcgcctgcgggaagccggcggggcaggtcggagaagagcgagaagatcgagaaactccaggccagcccgggaacatggcgccaggcgggccagccgcggactgagagccgcggggcagccaggagccggggcccgagccccgcccggcccgggccatgtcggtgggcgagctctacagccagtgcacaagggtctggatccctgaccctgatgaggtatggcgctcagctgagttaaccaaggactacaaagaaggagacaagagcctacagctcagactggaggatgaaacgattctggaatacccaattgatgtacaacgcaaccagctgcccttcttacggaatccagatatcttggtgggagaaaatgacctgactgcccttagctatcttcatgagcctgcagttttgcataatttgaaggtccgtttcctggagtccaaccatatctacacttactgtggtatcgtacttgttgccattaatccttatgaacagttgccaatctatggacaagatgtcatctatacctacagtggccaaaacatgggagacatggacccccacatctttgctgtggcagaagaagcctacaagcagatggccagagatgagaagaatcagtccatcatagtcagtggggagtctggagccgggaagacggtatcagccaagtatgccatgcgctatttcgccaccgttggtggctcggccagtgaaaccaacatcgaagagaaggtgctggcatccagtcccatcatggaggccattggaaatgccaagaccacccgcaatgacaacagcagccgttttggcaagtacatccagattggctttgacaaaaggtaccacatcatcggggccaacatgaggacttacctcttggagaagtccagagtggtcttccaggcagatgatgagaggaattaccacatcttttaccagctctgtgctgctgccggtcttccagaatttaaagagcttgcactaacaagtgcagaggactttttctatacatcacagggaggagacacttccatcgagggtgtggacgatgctgaggactttgagaagactcgacaagccttcacactcctcggagtgaaagagtcccatcagatgagcatttttaagataattgcttctatcttgcaccttggaagtgtggcgattcaggctgagcgtgatggtgattcctgtagtatatcaccccaggatgtatacctaagcaacttctgccgactgctaggggtggagcacagtcagatggagcactggctgtgtcatcgcaagctggtcaccacctcggagacctacgtcaagaccatgtccctgcagcaggtgatcaatgcgcgcaacgccctggcgaagcacatctatgcccagttgttcggctggattgtggagcacatcaacaaggccctgcacacctccctcaagcagcactccttcatcggggtcctggacatctatgggtttgagacatttgaggtaaacagctttgagcagttctgtatcaactatgcaaatgaaaagctccagcagcagttcaactcgcatgttttcaaactggagcaagaagaatacatgaaggaacagatcccttggaccctgattgatttttatgataaccaaccttgtatcgacctcattgaagccaagctgggtatcttggacctgttggatgaagaatgtaaggtccccaaaggaactgaccagaactgggctcagaagctctatgaccggcactccagcagccagcacttccagaagccccgcatgtccaacacggccttcatcatcgtccactttgcagacaaggtggagtacctctctgatggttttctggagaaaaacagagacacggtgtatgaagagcagatcaatatcctgaaggccagcaagttcccactagtggctgacttgtttcatgatgacaaggaccctgttcctgccaccacccctgggaaggggtcatcttcgaagatcagcgtccgttctgccagaccccccatgaaagtctccaacaaggagcacaagaaaaccgttggccaccagttccgtacctccctgcatctgctcatggagaccctgaatgccacgacacctcactatgtccgctgcatcaagcccaacgatgagaagctcccctttcactttgacccaaagagagcagtgcagcaactcagagcctgcggggtgttggagacgattcgaatcagtgcagctggctacccatccaggtgggcctaccatgactttttcaaccggtatcgggtgctggtcaagaagagagagctcgccaacacagacaaaaaggccatctgcaggtctgtcctggagaacctcatcaaggaccccgacaagttccagtttggccgcaccaagatcttctttcgagcaggccaggtggcctacctggagaagctgcgggctgacaagttccggacagccaccatcatgatccagaaaactgtccggggatggctgcagaaggtgaaatatcacaggctgaagggggctaccttaaccctgcagaggtactgccggggacacctggcccgcaggctggctgagcacctgcggaggatcagagcggctgtggtgctccagaaacattaccgcatgcagagggcccgccaggcctaccagagggtccgcagagctgccgttgttatccaggccttcacccgggccatgtttgtgcggagaacctaccgccaggtcctcatggagcacaaggccaccaccatccagaagcacgtgcggggctggatggcacgcaggcacttccagcggctgcgggatgcagccattgtcatccagtgtgccttccggatgctcaaggccaggcgggagctgaaggccctcaggattgaggcccgctcagcagagcatctgaaacgtctcaacgtgggcatggagaacaaggtggtccagctgcagcggaagatcgatgagcagaacaaagagttcaagacactttcagagcagttgtccgtgaccacctcaacatacaccatggaggtagagcggctgaagaaggagctggtgcactaccagcagagcccaggtgaggacaccagcctcaggctgcaggaggaggtggagagcctgcgcacagagctgcagagggcccactcggagcgcaagatcttggaggacgcccacagcagggagaaagatgagctgaggaagcgagttgcagacctggagcaagaaaatgctctcttgaaagatgagaaagaacagctcaacaaccaaatcctgtgccagtctaaagatgaatttgcccagaactctgtgaaggaaaatctcatgaagaaagaactggaggaggagcgatcccggtaccagaaccttgtgaaggaatattcacagttggagcagagatacgacaaccttcgggatgaaatgaccatcataaagcaaactccaggtcataggcggaacccatcaaaccaaagtagcttagaatctgactccaattacccctccatctccacatctgagatcggagacactgaggatgccctccagcaggtggaggaaattggcctggagaaggcagccatggacatgacggtcttcctgaagctgcagaagagagtacgggagctggagcaggagaggaaaaagctgcaagtgcagctggagaagagagaacagcaggacagcaagaaagtccaggcggaaccaccacagactgacatagatttggacccgaatgcagatctggcctacaatagtctgaagaggcaagagctggagtcagagaacaaaaagctgaagaatgacctgaatgagctgaggaaagccgtggccgaccaagccacgcagaataactccagccacggctccccagatagctacagcctcctgctgaaccagctcaagctggcccacgaggagctcgaggtgcgcaaggaggaggtgctcatcctcaggacccagatcgtgagcgccgaccagcggcgactcgccggcaggaacgcggagccgaacattaatgccagatcaagttggcctaacagtgaaaagcatgttgaccaggaggatgccattgaggcctatcacggggtctgccagacaaacagcaagactgaggattggggatatttaaatgaagatggagaactcggcttggcctaccaaggcctaaagcaagttgccaggctgctggaggctcagctgcaggcccagagcctggagcatgaggaggaggtggagcatctcaaggctcagctcgaggccctgaaggaggagatggacaaacagcagcagaccttctgccagacgctactgctctccccagaggcccaggtggaattcggcgttcagcaggaaatatcccggctgaccaacgagaatctggaccttaaagaactggtagaaaagctggaaaagaatgagaggaagctcaaaaagcaactgaagatttacatgaagaaagcccaggacctagaagctgcccaggcattggcccagagtgagaggaagcgccatgagctcaacaggcaggtcacggtccagcggaaagagaaggatttccagggcatgctggagtaccacaaagaggacgaggccctcctcatccggaacctggtgacagacttgaagccccagatgctgtcgggcacagtgccctgtctccccgcctacatcctctacatgtgcatccggcacgcggactacaccaacgacgatctcaaggtgcactccctgctgacctccaccatcaacggcattaagaaagtcctgaaaaagcacaatgatgactttgagatgacgtcattctggttatccaacacctgccgccttcttcactgtctgaagcagtacagcggggatgagggcttcatgactcagaacactgcaaagcagaatgaacactgtcttaagaattttgacctcaccgaataccgtcaggtgctgagtgacctttccattcagatctaccagcagctcattaaaattgccgagggcgtgttacagccgatgatagtttctgccatgttggaaaatgagagcattcagggtctatctggtgtgaagcccaccggctaccggaagcgctcctccagcatggcagatggggataactcatactgcctggaagctatcatccgccagatgaatgcctttcatacagtcatgtgtgaccagggcttggaccctgagatcatcctgcaggtattcaaacagctcttctacatgatcaacgcagtgactcttaacaacctgctcttgcggaaggacgtctgctcttggagcacaggcatgcaactcaggtacaatataagtcagcttgaggagtggcttcggggaagaaaccttcaccagagtggagcagttcagaccatggaacctctgatccaagcagcccagctcctgcaattaaagaagaaaacccaggaggacgcagaggctatctgctccctgtgtacctccctcagcacccagcagattgtcaaaattttaaacctttatactcccctgaatgaatttgaagaacgggtaacagtggcctttatacgaacaatccaggcacaactacaagagcggaatgaccctcagcaactgctattagatgccaagcacatgtttcctgttttgtttccatttaatccatcttctctaaccatggactcaatccacatcccagcgtgtctcaatctggaattcctcaatgaagtctgaagatgcatgtttccagcattagtttgattcccaatgtgagcaagaaggaagtatatacagtaaagtaaattcaaggatctgttaaatctggtaaaagtagatcaaatcagagattgacagcctgtggagggtgctgaactatacagaattagacacaactatgtcattattttttgtacctactgctcagaataaaaacacttgaaatatggaagattttaagtttgatttcagtccaacacatatacataatttatagacaccaagcagtccccatagacatataaaaggtgtcaattctataaaacgaagctgcctagttttgatctttgcatagaactagagaatgtccaaattaaaataccaaatatatataagtcacataaattgccttcaaagggctttaacaaataatggtactaataaccatgataatggcatatactgacatttcccaaagtttgcaaaccataggtgtggttgagtttgtggtgagatgttttaagaacaaaaatatggggatgagacttctgagaaatattcccaaaatattttttaatggctgattatacacagacagtggtgtaactgacctccagaccagacattttgagtactggtttctgaagcaaaattagaagtgccagtcctcagtgtgctcaaacgcttttgtgttatcttgatttaatggaagagattattaaaatgctgctatcccaaactccaagtgagaaagatggaaaaatattttgtttctgatgctagtccatacactttccaagtcccacaaaactttcacaaaaatgtatataagctaaatattagaaacggataacaaacttgttttatttatagatgtaaaaaccaaacaagtcaatatgaaagcttttaatctcttaataccattaagcttccagtaagagcatcacataatgctctactgttccagaaaccaaatagtaaaacaaactaaagttcgcacatcagatcatctgaaaaaccttcaaaaataatcagttcagggatattatacaaaagtttgggttttttttttttaagagaataaaatggcttaggtcaactttcccttttcaggttattttcaacgtttttcaaatttagcacacaaaaaattgtaaatatctctcccacaaaataaggattttaaaaaagtaattcagtaatataacaggcttagatgtttgctgctcttagaattttttttaacttgtttttggtttcttcaaaagcaagcattcaattggaaacccatattctttccacacttttttttactgtcttttctgtatttcttgatagcagtatgctgttcccataagaaaaaaatggtatttgcaaatcatggaagaacagcctctgtattacattgagaaaataagatttatccatgaattggaagtagaacagcctgccttcaccctcttttactcaaccacccaacttaaaaggctcttggaaacacagcacactccacgctaccttctgcactgtgcccttagagcacagcttcctcagttgttctctgcatctcctggggcttaggccagtcttagcctgggttaaggctgctgacattgtgttccaatcagttgtcatgggcattatcccctctacatccacattaaacatgccggcttctcttgggcatcggcagagctgtgcctttttctttcagttacagttacataatcactgacgtccatgacacttacccatggatccatgtgctgacttcatttagaaggccaatctaaaacaactgggtttgtggctacctctttaaagttgtttgtgaaggataatttgttttttaatgcactttagtttgaaagtgagtctcttatgtaaggaccatccttaaaagaccaaaaatgccttgttagagtgttaaggagttttgacatgcagtggttccacaaacacagtggcttactatccttatacactgtcttataccatcattctctccatctctcttggtcactactctctgctgtcactggttaatcactaggtgccaagagcttactgaataaaagcttggcaattagaataaatggggagggaaggaccttatgaatagtccatttagcctaagaaatggcagatttagttcttctcttccaaaagataaaggtatatcctggaattgtacttaaaacttacagatgactaacaaatatatactttatatgtagttaatatttagatctgtcttatttaatacttggaggctagaagaagcatctttaggggaactatataatcttttgttagcattttctctgcattttaaaaaatcatttcaattcaaacatttatcagtgtcatgaaatcagtaatgactctttaacaattcaggtttgaactctgcattagatgtctctttaattttttaatatttaaaatttagttgacatttttttcaccaggtgcctttagcggttactaagataactgacatcagttgtttctctgaaataagtgttgctgtgggaataattttaatgttcaaggtgatatcatgggggagttttgtcttttaaaacattagaagcattttaaatattaagaatcaaatatttatagatcaaaacttgtgttttaagtattatacgggacctgtttacttatagtaaatgtgaatgtacacatgagttgttgctgaagctgacaagcatattacatacatgcattttccctgtgccctcatagttgcagttagagttccagtacctgtaggctcacctgggaggcagattagacccaaaggtagatgtttttcccctttccatgaagcatgtcagtgggagttgcttcctttgatttccctagtactaaattttaaggcttttgtaaaaacaaaacaaaactaggagcttggaacagttaaaaatcaacactgctaccatcaattcatcaaatatttacttagagctttcatacattaagattccagtaaccaataaattagaattcatttcttctgcataaagtaaattttcatacacttgacctactaagacagcaagggtgtcctaaattgaggcatttgtataatgcctgcataactaaatggtcactaaaatgggacagcatggggcaagaccttgtagttcttcacagaatatttgtggtcagtttctccaattaatttgctgcatgagccaaataaccataattcactttttatacccactggtgccataattagagaattagagggtgtagacagaggttaatgccaatgagaaacacaggacagggttttttttattataaaggtcattagatacaaaagattgtttttcaaaaaatttctaattctaacaaaggggatcaatcagaaatgaaactaagctactttctaaagtgacactgtatcagaataatccagatttgaatataacattttgccaccaactgacatttagatgaaggactgcctctctgaaagagttcagatcatattcaggggtgaatccaacaccatggaagaaagactactgatgaaaatattttcccactttgcacaaatctgtaaactacacctttgtttatagaaaaatgcttgtaatagtcactgtaatatttagctgtggataaaaatttgtggaaataaatacttttgaataaagaggtgtgccaaatctaaatgaaa

SEQ ID NO: 330 - DNA, 2692 bp, Homo sapiens
gtcacggagcgcttaagaggagggtcgggctcggccggggagtcccagtggcggaggctacgaaacttgggggagtgcacagaagaacttcgggagcgcacgcgggaccagggaccaggctgagactcggggcgccagtccgggcaggggcagcgggagccggccgggtagggtgcagcctgaggcttgttcagcagaacaggtgcaagccacattgttgccaagacctgcctgaagccggattctccccactgcctccttcaaccccgcctcttcctcctcctgtgggactgctcccccctcctgtgaggctagatagatgccctgtatccaagcccaatatgggacaccagcaccgagtccgggaccccgtgaccacctggcaagcgaccccctgacccctgagttcatcaagcccaccatggacctggccagccccgaggcagcccccgctgcccccactgccctgcccagcttcagcaccttcatggacggctacacaggagagtttgacaccttcctctaccagctgccaggaacagtccagccatgctcctcagcctcctcctcggcctcctccacatcctcgtcctcagccacctcccctgcctctgcctccttcaagttcgaggacttccaggtgtacggctgctaccccggccccctgagcggcccagtggatgaggccctgtcctccagtggctctgactactatggcagcccctgctcggccccgtcgccctccacgcccagcttccagccgccccagctctctccctgggatggctccttcggccacttctcgcccagccagacttacgaaggcctgcgggcatggacagagcagctgcccaaagcctctgggcccccacagcctccagccttcttttccttcagtcctcccaccggccccagccccagcctggcccagagccccctgaagttgttcccctcacaggccacccaccagctgggggagggagagagctattccatgcctacggccttcccaggtttggcacccacttctccacaccttgagggctcggggatactggatacacccgtgacctcaaccaaggcccggagcggggccccaggtggaagtgaaggccgctgtgctgtgtgtggggacaacgcttcatgccagcattatggtgtccgcacatgtgagggctgcaagggcttcttcaagcgcacagtgcagaaaaacgccaagtacatctgcctggctaacaaggactgccctgtggacaagaggcggcgaaaccgctgccagttctgccgcttccagaagtgcctggcggtgggcatggtgaaggaagttgtccgaacagacagcctgaaggggcggcggggccggctaccttcaaaacccaagcagcccccagatgcctcccctgccaatctcctcacttccctggtccgtgcacacctggactcagggcccagcactgccaaactggactactccaagttccaggagctggtgctgccccactttgggaaggaagatgctggggatgtacagcagttctacgacctgctctccggttctctggaggtcatccgcaagtgggcggagaagatccctggctttgctgagctgtcaccggctgaccaggacctgttgctggagtcggccttcctggagctcttcatcctccgcctggcgtacaggtctaagccaggcgagggcaagctcatcttctgctcaggcctggtgctacaccggctgcagtgtgcccgtggcttcggggactggattgacagtatcctggccttctcaaggtccctgcacagcttgcttgtcgatgtccctgccttcgcctgcctctctgcccttgtcctcatcaccgaccggcatgggctgcaggagccgcggcgggtggaggagctgcagaaccgcatcgccagctgcctgaaggagcacgtggcagctgtggcgggcgagccccagccagccagctgcctgtcacgtctgttgggcaaactgcccgagctgcggaccctgtgcacccagggcctgcagcgcatcttctacctcaagctggaggacttggtgccccctccacccatcattgacaagatcttcatggacacgctgcccttctgacccctgcctgggaacacgtgtgcacatgcgcactctcatatgccaccccatgtgcctttagtccacggacccccagagcacccccaagcctgggcttgagctgcagaatgactccaccttctcacctgctccaggaggtttgcagggagctcaagcccttggggagggggatgccttcatgggggtgaccccacgatttgtcttatcccccccagcctggccccggcctttatgttttttgtaagataaaccgtttttaacacatagcgccgtgctgtaaataagcccagtgctgctgtaaatacaggaagaaagagcttgaggtgggagcggggctgggaggaagggatgggccccgccttcctgggcagcctttccagcctcctgctggctctctcttcctaccctccttccacatgtacataaactgtcactctaggaagaagacaaatgacagattctgacatttatatttgtgtattttcctggatttatagtatgtgacttttctgattaatatatttaatatattgaataaaaaatagacatgtagttggaactgaaaaaaaaaaaaaa

SEQ ID NO: 331 - DNA, 4133 bp, Homo sapiens
actcggctcctctcccccctcgcgcccacagcgtttggtgttgattcgagcgggaagaggggggtgggtgggatcggtgggggagaccatgacctccagctacgggcacgttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacaatgaccagctgaactcagaagaaaaaaagaagagaaagcagcgaaggaataggacaaccttcaatagcagccagctgcaggctttggagcgtgtctttgagcggacacactatcctgatgcttttgtgcgagaagaccttgcccgccgggtgaacctcaccgaggcgagagtgcaggtgtggtttcagaaccgaagagccaagttccgcaggaatgagagagccatgctagccaataaaaacgcttccctcctcaaatcctactcaggagacgtgactgctgtggagcagcccatcgtacctcgtcctgctccgagacccaccgattatctctcctgggggacagcgtctccgtacagatcctcgtccctcccaagatgttgtttacacgaggggcttcataacggattctaacggaagacactgaaaagcgccatggctacttattctgccacatgtgccaacaatagccctgcacagggcatcaacatggccaacagcattgccaacctgagactgaaggccaaggaatatagtttacagaggaaccaggtgccaacagtcaactgaggaaaaaaaataattaaacaggcctaagaagaaatcaaaaaccataagacacctatcctgctctgttatttcttcatctgctggggggaaaaagtaaattacaaacaaacaaacaaagcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagctaggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagatttttttaatttatattttcatcctgaccagcttagttctaataatttttagttgtgagtgattaaaaaactttggatcaattttggtcaaacatgccaactttgtagtctgagtgacaggcaaggatttttgggtttaagatgcacttttagcacacatttgtatttcccttggcatatcagattgagctaatggtgatgttatttcaatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgctagaatagaaatgatttcttttcaataaaaagaaagaaggactctaccatgtcttttgttatataca

SEQ ID NO: 332 - DNA, 4531 bp, Homo sapiens
agaggacgagagaagagctgaggggcgcgtcgccagcgcctgtgtctccctggcgcgggttccccaggctagcccgctggcccgtccgcgcgcgcgcccccggcccgcgcgccccttcccggggctcctggcctcgcctcagcggctgcaggctcttcgtcgcgggccgggctgcacgcgagcgccctccgggcagactttcgtcccccacccccgggagcgcggaaggctcactcgcagcgcatggtctacccgcgccgggcggagccccggcgtccagagcgctgcggccgcggcggtgcagcagaggcgcctcgggcaggaggagggcggcttctgcgagggcagcctgaggtattaaaaagtgtcagcaaactgcattgaataacagacatcctaagaggggatattttccacctctataatgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgatta

SEQ ID NO: 333 - DNA, 1469 bp, Homo sapiens
acatttgcgggaacgcagagcggagcgtggagagcggagcgaagctggataacaggggaccgatgatgtggcgaccatcagttctgctgcttctgttgctactgaggcacggggcccaggggaagccatccccagacgcaggccctcatggccaggggagggtgcaccaggcggcccccctgagcgacgctccccatgatgacgcccacgggaacttccagtacgaccatgaggctttcctgggacgggaagtggccaaggaattcgaccaactcaccccagaggaaagccaggcccgtctggggcggatcgtggaccgcatggaccgcgcgggggacggcgacggctgggtgtcgctggccgagcttcgcgcgtggatcgcgcacacgcagcagcggcacatacgggactcggtgagcgcggcctgggacacgtacgacacggaccgcgacgggcgtgtgggttgggaggagctgcgcaacgccacctatggccactacgcgcccggtgaagaatttcatgacgtggaggatgcagagacctacaaaaagatgctggctcgggacgagcggcgtttccgggtggccgaccaggatggggactcgatggccactcgagaggagctgacagccttcctgcaccccgaggagttccctcacatgcgggacatcgtgattgctgaaaccctggaggacctggacagaaacaaagatggctatgtccaggtggaggagtacatcgcggatctgtactcagccgagcctggggaggaggagccggcgtgggtgcagacggagaggcagcagttccgggacttccgggatctgaacaaggatgggcacctggatgggagtgaggtgggccactgggtgctgccccctgcccaggaccagcccctggtggaagccaaccacctgctgcacgagagcgacacggacaaggatgggcggctgagcaaagcggaaatcctgggtaattggaacatgtttgtgggcagtcaggccaccaactatggcgaggacctgacccggcaccacgatgagctgtgagcaccgcgcacctgccacagcctcagaggcccgcacaatgaccggaggaggggccgctgtggtctggccccctccctgtccaggccccgcaggaggcagatgcagtcccaggcatcctcctgcccctgggctctcagggaccccctgggtcggcttctgtccctgtcacacccccaaccccagggaggggctgtcatagtcccagaggataagcaatacctatttctgactgagtctcccagcccagacccagggacccttggccccaagctcagctctaagaaccgccccaacccctccagctccaaatctgagcctccaccacatagactgaaactcccctggccccagccctctcctgcctggcctggcctgggacacctcctctctgccaggaggcaataaaagccagcgccggga

SEQ ID NO: 334 - DNA, 2358 bp, Homo sapiens
gacattcagtgcagtctacctgcagcacagcacactccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaa

SEQ ID NO: 335 - DNA, 1843 bp, Homo sapiens
agcgcgggaccttcgggaaaccctggcgcgaggcgtcagaagctgtcggactcaccgggggccctaagcagcgagacctgaggccagacggaactacaacatgtaccatccacgagaattgtacccgtccctgggggccggctaccgcctggggcccgcccaacctggggccgactccagcttcccacccgccctagcggagggctaccgctaccccgaactggacacccctaaactggattgcttcctctccgggatggaggctgctccccgcaccctggccgcgcacccacctctgccccttctgccccctgccatgggcactgagccggccccatcagctccagaggccctccattccctcccgggggtcagcctgagcctggagaaccgggagctatggaaggagttcagctctgtgggaacagaaatgatcatcaccaaagctgggaggcgcatgttccctgcctgccgagtgtcagtcactggcctggaccccgaggcccgctacttgtttcttctggatgtgattccggtggatggggctcgctaccgctggcagggccggcgctgggagcccagcggcaaggcagagccccgcctgcctgaccgtgtctacattcaccccgactctcctgccactggtgcacattggatgcggcagcctgtgtctttccatcgtgtcaagctcaccaacagcacgctggacccccacggccacctgatcctgcactccatgcacaagtaccaaccccgcatacacctagttcgggcagcccagctctgcagccagcactgggggggcatggcctccttccgcttccccgagaccacattcatctccgtgacagcctaccagaacccacagatcacacaactgaagattgcagccaatccctttgccaaaggcttccgggagaacggcagaaactgtaagagggagcgagacgcccgtgtgaagaggaaactgcggggcccagagccagcagccacagaggcctatgggagcggagacacaccaggtggtccctgcgactccaccctgggtggagacattcgtgaatcagatccagaacaggccccagcccccggggaagccaccgctgccccggcacctctgtgtggtggccccagtgctgaggcctacctcctgcaccctgcggctttccatggggcccccagtcaccttcccaccaggagccccagcttcccggaggctccagactccgggcgctcagccccctactcggctgcatttctggagctgccgcacgggtcagggggctccgggtacccagcggctccaccggcggtaccctttgccccgcactttctccaagggggccccttccctctaccatacaccgcgcctgggggctatctggatgtgggctccaaacccatgtactgaaccactgctgggcccctctgcctccatcacaaacctcccgctcccttcccccagccctggagccccctcacctccaccggccccatcccccacaccaaatggccgccttgggcctgcccacccaccccctcaacttcacaccttgatttcactcccacccccctctggcttcaaagcctaaccaaggctgctgggagtccagctggggccggcttccccttcccggctctcacctccgtgtgaatggaaggggctctgcctggccaaatggggccacagaccagcatccccacttaccaggcctccccatgggctctggaggggctcaatccccacccccccacacacactggtgcaggccacaccagtctgttgttctgggaccagagtatttttgttaataaaactcaaaagccatccatgctcaggaaa

SEQ ID NO: 336 - DNA, 7562 bp, Homo sapiens
tcccaaaacagaaagagcagatgtctcaccacgaaactagcaactggaatgaagatagaaacaagtggttataactcagacaaactaatttgtcgagggtttattggaacacctgccccaccggtttgcgacagcaagtttctcctgtcgccttcgtcagacgtcagaatgattccttgcagagccgcgctgacctttgcccgatgtctgatccggagaaaaatcgtgaccctggacagtctagaagacaccaaattatgccgctgcttatccaccatggacctcattgccctgggcgttggaagcacccttggggccggggtttatgtcctcgctggggaggtggccaaggcagactcgggccccagcatcgtggtgtccttcctcattgctgccctggcttcagtgatggctggcctctgctatgccgaatttggggcccgtgttcccaagacggggtctgcatatttgtacacctacgtgactgtcggagagctgtgggccttcatcactggctggaatctcattttatcgtatgtgataggtacatcaagtgttgcaagagcctggagtggcacctttgatgaacttcttagcaaacagattggtcagtttttgaggacatacttcagaatgaattacactggtcttgcagaatatcccgatttttttgctgtgtgccttatattacttctagcaggtcttttgtcttttggagtaaaagagtctgcttgggtgaataaagtcttcacagctgttaatattctcgtccttctgtttgtgatggttgctgggtttgtgaaaggaaatgtggcaaactggaagattagtgaagagtttctcaaaaatatatcagcaagtgccagagagccaccttctgaaaacggaacaagtatctatggggctggtggctttatgccttatggctttacgggaacgttggctggtgctgcaacttgcttttatgcctttgtgggatttgactgcattgcaacaactggtgaagaagttcggaatccccagaaagctattcccattggaattgtgacgtctttgcttgtttgctttatggcctattttggggtctctgcagctttaacacttatgatgccgtactacctcctcgatgaaaaaagcccccttcctgtagcgtttgaatatgtgggatggggtcctgccaaatatgtcgtcgcagctggttctctctgcgccttgtcaacaagtcttctgggctctatgtttcctttaccccgaattctgtttgccatggcccgggatggcttactgtttagatttcttgccagagtgagtaagaggcagtcaccagttgctgccacgttgactgcaggggtcatttctgctttgatggcctttctgtttgacctgaaggcgcttgtggacatgatgtccattggcacactcatggcctactctctggtggcagcctgtgttctcatcctcaggtaccagcctggcttatcttacgaccagcccaaatgttctcctgagaaagatggtctgggatcgtctcccagggtaacctcgaagagtgagtcccaggtcaccatgctgcagagacagggcttcagcatgcggaccctcttctgcccctcccttctgccaacacagcagtcagcttctctcgtgagctttctggtaggattcctagctttcctcgtgttgggcctgagtgtcttgaccacttacggagttcatgccatcaccaggctggaggcctggagcctcgctctcctcgcgctgtttcttgttctcttcgttgccatcgttctcaccatctggaggcagccccagaatcagcaaaaagtagccttcatggttccattcttaccatttttgccagcgttcagcatcttggtgaacatttacttgatggtccagttaagtgcagacacttgggtcagattcagcatttggatggcaattggcttcctgatttacttttcttatggcattagacacagcctggagggtcatctgagagatgaaaacaatgaagaagatgcttatccagacaacgttcatgcagcagcagaagaaaaatctgccattcaagcaaatgaccatcacccaagaaatctcagttcacctttcatattccatgaaaagacaagtgaattctaacacttgcaggagcagagctggtcatcgtcttagcatacatatcctacactgagtaaaccgtaacgggatgtcatcagcatgctgggttgtcatgggtttgctgcatacatagttcaccctaatttatacttactcatctggacagcatctcctcagatggtgaattatgtgcacggggaaacctcctgagtggaagtttcattcatcagtgatgaatagcccccaaacagtgggagtgtgtatgtatgtgtgtatgtatgtatctatgtatatgcttgggaacatgagtgttacaagttagctggtgttttactattattgtgttacatttttccagtgtcgtcattaatcggtggcatatactgcacatactgaaatagagggaaatcactgaatgtaaagaggtttcatctatgccccctgcagttggggaaatactagtagctttaccttgtttgacttcattaatgtcagtttaggggatgccaaaaatgcagttactcatcatggtgtctgtcactggttaggggtaagatgaggggataaggaaagagacttttcaataagttgtgaatgccaacagtgggtttaatgcaaattttttttcctgtgaggtatgacagtttgctcaaacttcagccaacaggggtgtctgcttctgctgcactacacaggccaggagtggcattccatgccactagttggcatccttttgaacttttgtctcctttgcaaacagtggtcctaaaatacgaggtcttcacttgctgtgaatgacgtatccccagtcagggacttaagagaggcactgtgatatacttgggaccctttaaattaaaaagtgaagatagtcaccagggccagaaagctcatggagtggccgtaatgagaatatgtttgaagatcaaagagttagaccaatgcttgaataagtagaccccaagcatccttttctaaaaagtgacttaaaataagccaacagactctcccagaccacacaactagtggaatgattcctcctttttccattacttacttaatcacagtttagtttttttcttaacctcgtcaggcccagagttcacttctttgtttctctgtttcttttgtcttgtcttagagatgagggggctacagcagcatcatgcaaagagggaaagatgaagggatagaagaagagaaaatccccctgttctgataggaacggcctgttccattgttaaatggcaaatggcccaatttaagggctttggatctaatttgcctctgatgtttcctttggaaacatttaggaatatttttctccccctaccccataaattgtgtagcactttttattccatttgctttcaaatgactacactaagcctaataatacaagctccagtgttatacaataacccatcagtgattggggaatcaaacattttggtttaaaaaacatgattatttaaaactggaaactaaaaagaatcaaattgaattaaagctatataaacacagttaacccttgtaaatgagtaaacaaatttttacatgtaagattctctaattgtcatattttactttttaggattccctaatagtggactgtttatttgcagtgtatttgcttctcatgaactatttctcgtacaaatcattaaatagttcattggatgaggctgggtgacatttcccaggacagcatggtgaacattaccaggcatgctagctggcccgtgtaatcccaagacaaggaaaacattcgttttcctcatgggtcttccaagaaatgagctattttattgatgccattaaaaagcaagttgcgatggttttgtatagccaggagtttattgtgattaaacatcaaagaaacaggtagaaagcctgggtttctggctgctagcgttatagcatccatgacacagaactcattacggacattccacaacttccagggtgcacatggtaaaatctgaagcccagaattttctctcaagctgcgtggtttactggagagaaggagttggataagcacaggctcgggtattttggtagggactgtaggcatgctcataaatccttgctgttgtcacagtacgctgaaaacccgtttgattctatacccaatcaagaatagacccttcacacaggaaatgtgaacaattgttatatatgaacactcaaatcttttactgtaacgaaaccaagaaacttgtttagaatgtgataggcagctaaaactgttatgcccactgtgctcaatttgaagcagaatttagtgaaaaattatttttccacattgaaacactttgcagacacaaatatctatgaaaagatgctttgtcagccactgtgcctttttttctgtgaagactcaacggatgtgtgtgtttgtatgtttgttaacagttacatatgtttgtatgagtgtatatatatatctgtgtgtgtgtatctctaacgtcagtgtataagtaagttgggtttatggtgggctttgactatgtcattaggtgggtacaaaacccaactgatgtggagaaaaattgatgtttgatgttgatagatatgcttatacctaatttttagtttttaaactattttaaaatatactatgattttatatgtatatttcctatagactctttaagacgtatttataatgtttctaatatgaaatcactaaactctagtacattatagcaggtgctttgtaatctggaatggagaagaggtaggggcatttggggattcctgtttacttgctgctgccacaccttttccgactgatctgtcctggtaggtgtttattagcaaaagtcagtatcaccagctctttggcacctttctgtttctgcttgtgaattcataatgttttcaactaaattttttttttctttctcagaattacctaaatgttttgtagagttttgactagtaatcaatcaaaattatataaagtcttctccagtaattaagaaatacatatgcaaattcttttgtgattgagtaaaagcagcttaaattacttttcttttctacattaagaaatatattctcaacattttcagtgagaatttcttgtaatggcacctcaaattttatactcttaaaaaaaaacaataatttgtgaattaccaccaaaaggcaatggcagtcctacatttaagaatagagctatgcaaactctgttaaaaactatgaggaaaacttatattagaacttttgatatatactaaaatactgattatcttaatcacattttccccagagataaacattgagagaacgaaagccaaagtgtcatttaagagagatatatatgaaaaagtaacattaatatatagaactttaccatcaccagccgtagttgatagaaaatattagtttcagaattaccctcctttaaaaaataagagactatttgttttcttttaatttctatgaataaaagaaatttttaaaaactttaaaattttaaatattagtcaaaatactttttaagtcctgagtgcttacaggtagttgttaaaaaaattttaaggccaggcatggtggctcgctcacacctataatcctaggatcttgggaggtcgaggcaagctgatcgcttgagcccaggagtttaagaccggcctgagtagcatagcaagaccctgtctctacaaaaaaaacaaaaattagctgggcatggtggcatgcacatgtagtcagagctactgggggtgctgaggtgggaggatcgcttgagcccaggagagtgaggctgcagtgagctgagattacgccactgcactctagcctgggcaacggtgagaccctgcctcaaaaaaaataaaaataaaaataaaacactttaattagaatctatttttacctattttctaaatttatttaaatgcttagcaggaagcataaggaaaagccatcggcctccaatacccatgatgacagagggagcacttgagccttgccttccctcctcttaaatcagggtgtgttccgagattacagaacatcacaccttggcgtgatgaaatcatgccaagattctgactctccctttccggtgatactgctcatgatttctcctaatacgcttcaagcaactgttaccacaaaaaatacagtttccgcagggctttaaaggattgagtttagcatgtatatcatgcgttattaaagttcacgtgattcatgtgaaattaactgtcctttttgctagtgccaaaacagtgccttctctgcacactttacttgtttataaagttctcccacatgtccttaaatatcaagggggaaagtatggatattcgcgtagcaataatgccagcaaaggtcattttcattttttagtcatatagatatgaaaataagttcatatagatatgaaattgcttgactttattgttttggggagattttttttccttacatgattatattaaacactttaaaatagccttccggtttctggattttgagaagcctgatctgttattgttgtggttgttggtgtttgtaatattcattattgtttgtatatacacggtttagtcttactgatttcaaatgcattttgttattgctcaacccaactggtaacactgtttgctgggagcattatacttaactttgattcaccatggttgatgccactgccatgatcgctgggtcttaaagagctttccctagccactgacagccccgtggagatcataatcagggccccaggctggttccaggatcaggcagcctatagagtgtgagcatctatgtgtagctacccttgttgggtgggctcttagactgatggggtaggatatgaagtgaaagacttcaaatgcaagtaaggtagtttgggctccttaattccaaacatcccatgagtatatcaagatgaataaggaccaagggacctctgtgactcatagaagggctggctgaatcctgaagtagcatagtgggacctggtctacaatttatgcacatgcactgacagccttgctgtgccacgtgtctcaccaagacccagttgggaaagagcgtcatattgccaacaggttgggtttctctggcctacacctgattaatgggccctttatctttggtgtcccctaggagtgtccagttgttttattgctgtattttgttattgcagtacttaataaaaattgttgatagggcccaaaaccctacagaaattctatgtctgtaaaaaccaacaaaggcattggacttgtgtgaatgtacagggtttttttagtagtaattttaaatttaaatgttttaagtgatcatcagtgttcctttttacttataaagttggattcttttttagaatttgtaataaataaaaactgctgctttaccactgtaaaatatgctttctgatgtggtgtatttttaaaataaattttaatatgtaataa

SEQ ID NO: 337 - DNA, 4366 bp, Homo sapiens
agctgaatgggcgcgagagcggcgctgggggcgggtgggggcgcggggtaccgggctggcggccggccggcgccccctcattagtatgcggacgaaggcggcgggctgcgcggagcggcgtcccctgcagccgcggaccgaggcagcggcggcacctgccggccgagcaatgccaagtgagtacacctatgtgaaactgagaagtgattgctcgaggccttccctgcaatggtacacccgagctcaaagcaagatgagaaggcccagcttgttattaaaagacatcctcaaatgtacattgcttgtgtttggagtgtggatcctttatatcctcaagttaaattatactactgaagaatgtgacatgaaaaaaatgcattatgtggaccctgaccatgtaaagagagctcagaaatatgctcagcaagtcttgcagaaggaatgtcgtcccaagtttgccaagacatcaatggcgctgttatttgagcacaggtatagcgtggacttactcccttttgtgcagaaggcccccaaagacagtgaagctgagtccaagtacgatcctccttttgggttccggaagttctccagtaaagtccagaccctcttggaactcttgccagagcacgacctccctgaacacttgaaagccaagacctgtcggcgctgtgtggttattggaagcggaggaatactgcacggattagaactgggccacaccctgaaccagttcgatgttgtgataaggttaaacagtgcaccagttgagggatattcagaacatgttggaaataaaactactataaggatgacttatccagagggcgcaccactgtctgaccttgaatattattccaatgacttatttgttgctgttttatttaagagtgttgatttcaactggcttcaagcaatggtaaaaaaggaaaccctgccattctgggtacgactcttcttttggaagcaggtggcagaaaaaatcccactgcagccaaaacatttcaggattttgaatccagttatcatcaaagagactgcctttgacatccttcagtactcagagcctcagtcaaggttctggggccgagataagaacgtccccacaatcggtgtcattgccgttgtcttagccacacatctgtgcgatgaagtcagtttggcgggttttggatatgacctcaatcaacccagaacacctttgcactacttcgacagtcaatgcatggctgctatgaactttcagaccatgcataatgtgacaacggaaaccaagttcctcttaaagctggtcaaagagggagtggtgaaagatctcagtggaggcattgatcgtgaattttgaacacagaaaacctcagttgaaaatgcaactctaactctgagagctgtttttgacagccttcttgatgtatttctccatcctgcagatactttgaagtgcagctcatgtttttaacttttaatttaaaaacacaaaaaaaattttagctcttcccactttttttttcctatttatttgaggtcagtgtttgtttttgcacaccattttgtaaatgaaacttaagaattgaattggaaagacttctcaaagagaattgtatgtaacgatgttgtattgatttttaagaaagtaatttaatttgtaaaacttctgctcgtttacactgcacattgaatacaggtaactaattggaaggagaggggaggtcactcttttgatggtggccctgaacctcattctggttccctgctgcgctgcttggtgtgacccacggaggatccactcccaggatgacgtgctccgtagctctgctgctgatactgggtctgcgatgcagcggcgtgaggcctgggctggttggagaaggtcacaacccttctctgttggtctgccttctgctgaaagactcgagaaccaaccagggaagctgtcctggaggtccctggtcggagagggacatagaatctgtgacctctgacaactgtgaagccaccctgggctacagaaaccacagtcttcccagcaattattacaattcttgaattccttggggattttttactgccctttcaaagcacttaagtgttagatctaacgtgttccagtgtctgtctgaggtgacttaaaaaatcagaacaaaacttctattatccagagtcatgggagagtacaccctttccaggaataatgttttgggaaacactgaaatgaaatcttcccagtattataaattgtgtatttaaaaaaaagaaacttttctgaatgcctacctggcggtgtataccaggcagtgtgccagtttaaaaagatgaaaaagaataaaaacttttgaggaactctcgtagtctggttaatttgggtgcttatgtctatgaatctacccaaaacctccttcttggatgctgctgctaggcggagacctctctgtggatgccagtagtgagggacagagaattaaggcacctggtcctgcaagctgcttgagtccagacaactgtgaacccttctgaagagatgctgggtgtcggtggcttcctccccaaagacaggctgcccctagcttctgtctcttaatggctctagcctctgatatcagaagatctgctactctgttcccagcctgccccagactcggctgccgccatcgctgttctccactctgtggctgctcttgtcactaatgctacctgcctccactttcccttcctgcaactgcttgtgcagccccagtgcagccttggccccagcccattcgaacgtcttcccatctccctcctcctcaccatatgcagggccaggagtcaggtcatagcattcaaagcagagtcccttctgtctcctggggtctgggatccagctcagagtggccaggagagcaaaagtcatatttctctcgttttgtgtctttacagataattttgtatgaattttatttcctactctataagctactgcttgtttaagagaaaatgttttaagattatcacccatcaaatgagtttagaaaattgagactctggaagatggtccacagctcccttgtggctcaggtggtgctgggcttacaccacacagctccacccctacatccctcagggggttattggagaagccggaacttcctcagacaacgttcttaatgctacgagcgcctccttgctggtatgaggagacttgcctacctgcttctcaaggctgctgggatgtgtggtgctcaaagcttccacttggtcagcttgcagccattctcaggcctgctcccatccccatccctcctccctgtaaggcccttcttgcatccttaggttgctttgctcatgtctctcaacttttacttactcaggtggtaagcagataccctaaaaaggtatatttttgtagaccttttatagagtccaccagccaataggagttggctggagatcattctcaagaacttttcacactttggcattcatttgttggaagttgcatcttcacttcagagctgtgcccccattactcccccaccccacacacactcttctgaaaacagacctttgctaggtgcctctgggtgttctaaagttgatctccagtaactgagaattcactgccacactaacagctttgtattgcattctagacccgcacacacaccctccgacataaatgaaatcactggttctgaggcaacttaggaagacttacacatgttctgtattttaacatgcttctagaactttgagctgcagaaaatttcagttttagggttttttaattttaatttttgattgatacatagtgatgtgcatattttgagggtccatgtgataatgtaatacatttgtgtaattataaggagcaaatctgtgtaactgggatatctgtcacattaaatatttgtctttatggtagaaacatttgaattattctagtgattttgaaatacacagtaaattattgtaaactataggcattctactgacctatcaaacactaggtcttgtttcttttatcaaactgtatgtttgtacccattaatcaacctctcttcatttccccctacccttcttggcctctggtaactaccaatctactctctatcttcatgagatccacttttttagctcctacataggaatgagaacatgtgatatttgtctttctgtgtttggcttatttcacttaacatcacctccagttccatccatcttgctgcagataacatgatttcaacctttttatggcagaataatattccattgtgtatatataccacattttctttattcattcacccattgatggacacttaggttgatttcatgttttggctatgtgaatagcgctgcaataaatatgggagtatagatatatcttcaa

SEQ ID NO: 338 - DNA, 10474 bp, Homo sapiens
agttgctcccagcagtggccctgggaccagctctgctccttgcaccccgctccctgcctggacacaggctcactcgctgccttcttctgggggaaaccagcttcttgccagccacagctgctgcctccgccactggccaccgcccctgtcctgggagtcccttggcccagacacccacctgacttagtggctcctctgcaggaaaggtggctgccccctgcgttcctccatccaaccatgagctggtgcccatcaccactgagaatgcaccaaagaatgtagtggacaagggagaaggagcctcccggggtggaaacacacggaaaagcctcgaggacaacggctccaccagggtcaccccgagtgtccagccccacctccagcccatcagaaacatgagtgtgagccggaccatggaggacagctgtgagctggacctggtgtacgtcacagagaggatcatcgctgtctccttccccagcacagccaatgaggagaacttccggagcaacctccgtgaggtggcgcagatgctcaagtccaaacatggaggcaactacctgctgttcaacctctctgagcggagacctgacatcacgaagctccatgccaaggtactggaatttggctggcccgacctccacaccccagccctggagaagatctgcagcatctgtaaggccatggacacatggctcaatgcagaccctcacaatgtcgttgttctacacaacaagggaaaccgaggcaggataggagttgtcatcgcggcttacatgcactacagcaacatttctgccagtgcggaccaggctctggaccggtttgcaatgaagcggttctatgaggataagattgtgcccattggccagccatcccaaagaaggtacgtgcattacttcagtggcctgctctccggctccatcaaaatgaacaacaagcccttgtttctgcaccacgtgatcatgcacggcatccccaactttgagtctaaaggaggatgtcggccatttctccgcatctaccaggccatgcaacctgtgtacacatctggcatctacaacatcccaggagacagccagactagcgtctgcatcaccatcgagccaggactgctcttgaagggagacatcttgctgaagtgctaccacaagaagttccgaagcccagcccgagacgtcatcttccgtgtgcagttccacacctgtgccatccatgacctgggggttgtctttgggaaggaggaccttgatgatgctttcaaagatgatcgatttccagagtatggcaaagtggagtttgtattttcttatgggccagagaaaattcaaggcatggagcacctggagaacgggccgagcgtgtctgtggactataacacctccgaccccctcatccgctgggactcctacgacaacttcagtgggcatcgagatgacggcatggaggaggtggtgggacacacgcaggggccactagatgggagcctgtatgctaaggtgaagaagaaagactccctgcacggcagcaccggggctgttaatgccacacgtcctacactgtcggccacccccaaccacgtggaacacacgctttctgtgagcagcgactcgggcaactccacagcctccaccaagaccgacaagaccgacgagcctgtccccggggcctccagtgccactgctgccttgagtccccaggagaagcgggagctggaccgcctgctgagtggctttggcttagagcgagagaagcaaggcgccatgtaccacacccagcacctcaggtcccgcccagcagggggctcggctgtgccctcctctggacgccacgttgtcccagcccaggttcatgtcaatggtggggcgttagcatctgagcgggagacagacatcctggacgatgaattgccaaaccaggatggtcacagtgcgggcagcatgggcacactctcttctctggacggggtcaccaacaccagtgaggggggctacccagaggccctgtccccactgaccaacggtctggacaagtcctaccccatggagcctatggtcaatggaggaggctacccctacgagtctgccagccgggcggggcctgcccatgctggccacacggcccccatgcggccctcctactctgcacaggagggtttagctggctaccagagggaggggccccacccagcctggccacagccagtgaccacctcccactatgcccatgaccccagcggtatgttccgctctcaatccttttcggaagctgaaccccagctgcccccagctccggtccgagggggaagcagccgggaggctgtgcaaaggggactgaattcgtggcagcagcagcagcagcagcagcagcagcctcgcccacctccacgccagcaggaaagagcccacttggagagtcttgtagccagcaggcccagccctcagccattggcagagacccccatccccagtctccctgagttcccgcgagcagcctcccagcaggagattgaacagtccatcgaaacactcaatatgctgatgctggacctggagccagcctccgctgctgccccactacacaagtcccagagtgtccccggggcctggccaggggcttctccactctcctcccagcccctctctggatcctcccgtcagtcccatccactgacccagtccagatctggctatatccccagtgggcattcgttgggaacccctgagccagccccacgggcctctctggagtctgtccctcctggcaggtcttactcaccttatgactatcagccatgtttggctgggcctaaccaggatttccattcaaagagcccagcctcttcctccttgcctgccttccttccgaccacccacagccctccagggcctcagcaacccccagcctctctccctggcctcactgctcagcctctgctctcaccaaaggaagcgacttcagacccctcccggactccagaggaggagccattgaatttagaagggctggtggcccacagggtagcaggggtacaggctcgggagaagcagcctgcagagcccccagcccctctgcggaggcgggcggccagtgatggacagtatgagaaccagtctccagaagccacatcccctcgtagccctggggttcgctcccctgtccagtgtgtctccccggagctggctcttaccatcgctctcaatcctggagggcggcccaaagagccccatttgcacagctacaaggaggccttcgaggagatggagggaacctccccgagcagcccaccacccagtggggtgcggtcccccccgggtctggccaagacacccctgtctgctctgggcctgaaacctcacaacccagcggacatcctgttgcaccccacaggagttaccagaagacggatccagccagaggaagatgaggggaaggtggtggtcaggctgtcagaagagccccggagctatgtggagtctgtggcacggacagcggtggctggaccccgagctcaggactctgagcccaagagctttagtgctccagccacccaggcctatggccatgagatacccctgaggaacgggaccctgggtggctcctttgtctcccccagccccctctccaccagcagccccatcctcagtgctgacagcacttcagtggggagtttcccgtcgggagagagcagtgaccagggtccccggacgcccacccagcctctgttggagtctggcttccgctcaggcagcctgggacagcccagcccgtctgcccagagaaactaccagagctcttctcctctcccgactgtgggcagtagctacagcagccccgactactcacttcagcatttcagctcctctccggaaagccaggctcgagctcagttcagtgtggctggcgtccacacggtgcctgggagccctcaggcgcgccacagaacagtgggcaccaacactccccctagtcctggcttcggctggcgggccatcaatcccagcatggctgcccccagcagtcccagtttgagccatcaccagatgatgggtccaccaggcactggcttccatggtagcactgtctccagcccccagagcagtgcagcgaccaccccggggagccccagcctgtgtcggcacccagcaggggtctaccaggtttctggcctccacaacaaagtggccaccaccccggggagtcccagcctgggccggcaccctggggctcaccaaggcaacctggcctccggtcttcatagcaatgcaatagccagccctggaagccccagcctgggccgtcacctcggagggtctggatctgtggttcccggcagcccctgcttggaccggcatgtggcctatggtggctattctaccccggaggatcggagacccacactgtcccggcagagcagtgcctctggctaccaggctccttccacgccctccttccctgtctcccctgcctactaccctggcctgagcagccctgccacctccccgtcaccagactccgcagccttccggcaagggagcccaacaccagccttgccagagaagcgaaggatgtcagtgggagaccgggcaggcagcctccccaactatgccaccatcaatgggaaggtgtcttcgcctgtcgccagcggcatgtccagtcccagtgggggcagcaccgtctccttctcccacactctgcccgacttctccaagtactccatgccagacaacagcccggagacgcgggctaaagtgaagtttgtccaggacacttctaagtattggtacaagcctgagatctccagggagcaggccatcgcgctcctcaaggaccaggagccgggggccttcatcatccgcgacagtcactccttccgaggcgcgtacgggctggccatgaaggtgtcttcgccacctccaaccatcatgcagcagaataaaaaaggagacatgacccatgagctggtcaggcattttctgatagagactggccccagaggagtcaagctcaagggctgccccaatgagccaaacttcggatcgctgtctgccctggtctaccagcactccatcatcccattggccctgccttgcaagctggtcattccaaaccgagaccccacagatgaatcgaaagatagctccggccctgccaactcaactgcagacctgctgaaacaaggggcagcctgcaatgtgctcttcgtcaactctgtggacatggagtcactcactgggccacaggccatctctaaagccacatctgagacgttggctgcagaccccacgccagctgccaccatcgttcacttcaaagtctctgcccagggaatcactctgactgacaaccagagaaagctctttttcagacgccactaccctctcaacactgtcaccttctgtgacctggatccacaggaaagaaagtggatgaaaacagagggtggtgcccctgctaagctcttcggcttcgtggcccggaagcagggcagcaccacggacaacgcctgccacctctttgctgagcttgaccccaaccagccggcctctgccatcgtcaacttcgtctccaaggtcatgctgaatgccggccaaaagagatgaaccctgccccttgcccagggccagtgccatggggaaggggcttgtggggaggggacccatgaatcctgaccactcttgaacccagaaggaggactttgggccaatttcggaggagagaagaaagtgcaacgtggggagagggaagtgaattgcagaggggagggggaaaagagagagagagagagagagagagagagagagaaagatggaggagaagaacttggattcccctgggtagatggaaactgcaaaaacccaaagcctccaaaactaaccaggtccacctaacaccccctccctcccctaagaagatggatgtcctcaaaagagaaggaacaaacctccttgggaatccacattttttgggggaatggaaaagctctgtctccctaactcaactgctttgcaaggggaaatcaagctgggagaatctttttctggccacctgtggggtaggttgtcaaaccaaacagagccaccgtgggacatcaagtggaagaacttgtttgcttgaaagtatctcagacccaaggcacctcaggtctctttgctgtgcctccactatattgtcgtgtgggtgtgtgtctgcacccacatcctcacacattgatctagatctgcctttatccactcgaattataaacagctcggcttgtccttgtcccatgtgtttgtagacacacatgcatactgtccaaagattagggttggtggtggcagtgcagcaggggagggacaaacaaccaagctatgggtgacagaggctctctcctggtgcctgcacctgcactctagtgaccctgggtgccgccagacccttctcttctacaaagaccccagcaggagtgggagggtctgcaatggcatcgccctgtcctgccttggccagaagcctggagctttggtttgaggaggtagagatatgtgtatccataggaagagatctgtcagaacaggcagctgttgagctcggggtgtcttccccaaggcatgtggctcagcagcaagaaaggcaagttgctcctgctggggccctggactctgccttagctcccacctctcagccttgttattgggtttcatgcccctggaccagccttatctcagacctgcttacctgcatgatgcctttttgggggctggggattgagtcttgctgctctgcccagccctgttctattctgcagggtccctgtgttggaattctccctggggaacctactttctgctcagtgaggctccggccagaaacctggagtccttatcctcccctctgtaagtgttttagggtctggcttttgcaggcaccctctgacctcagcagagctcctgggcctgctgcctgcacaccacatcgcctacctacaatgccaaagcctcactgtcaccctttctgccttggtttccctagctgagccacgctgcccatgcagcagagggcagaaggcttgcacttgggccaaagggcctaaggtccactggacagttgggaaaacacctgaccaccatttaaggactctaagccagaatggaaaattcaccaggactccattcttaagcctatgcgagtcccctagagagaggcattgtactgatatataaatattatataatatatacatgagacatactgacagaatctgtaagctaataaaatgtaagaaaaggttaaaaaaagaataggtaaattgacaagaagtatttattgtttttccatattgctttattgccttccttggggataaaccaattcctatccttttttatatgtgtaagtaaagcctgaagtgtagggggcctttgttcttgaagcagccagggtctccttgccctggccttggccttccctagactgtgtggggctcagcattgggaggggttgcacatgtcccagcctttggcccccttacttttcagcaagccaggggcccagcagtcagctcccaggatgtgtggggagctgtccctgactctgcaggcctgagcgagtgtgtgagcatgcggggacatgggtgtgtatggcacacataggtgcgtgtgtgtcttttgtattttttctcctccaaggagctgtgtcagtgtggacgttctgtttcagggagttggaaaggagggtgtctgcagaaggtggagagcaggggcagaggccccactggccaccccctgcttcccagagtgaaaccttgtgcctggtgaccaaagtccctccaaagtgctcttccttctgggttattcaagccaaatatctgggtttccccctctcctcattccctagcaaaccccaattatcttccaagataggagatatttcccatccccttcctttgtaaatatctcatctcccactggagagcccaggagcctattcctggcatggatgttctgtccacacttgaggctgggcggtgtatcagacccttcaagcagcctggctggggcccaggactgagtctggggtcagctttcacggtcgcttttcccttcctcaccacccaccacagcccaccttgcatgcatggccagcccctccactccagcctgagccatgtgtgcccctgcgggaggacccattcatgccagaaagctggtaactccctcccagcatccctgcggaaggagtcagtttctgagagtgtgacttttcaaggcgaatgatggggaagggttccccagtccccacagtggccccacctctgggccctgcaccagagcccttctgtgtcacggcgggctgtgcacccatgcacacacctacgcacacacaacactccgcactgcagtatattcttgccaaagatttcctttaaaagcaagcacttttactaattattattttgtaaatgtttatcttcttctgtcttctccctccctgaatctattttactgttgtttattgttgaatctgtgtgtcagccaggagagcgctgtctggccttgaacatgggctgggatgggaaagggtctgggagaagatgggcaacaaagagccagggagtcatggacatcgcagcgacgcagaccccagcaggttcagtcccgtgctgccaccagctgtccagctgggtgtctggagggaagagggcagaggagggtcatgtcccttcagctgggggaggggcccagtgagctccacgtggctttttcccaaagggagcaagagggaaggattgggcgagaaaacaatggagaggggacctgcgaaggaaaacagggaggaagtgagcggtttgatcagcctgctatcacggtgttctggctctcttatttagccaggcgcttaagggacagatacatcacatcctaagtttgggaaaggcctttgacccatgtcatctgagcgtctcctccagtagctctgaaagctgtggacaccaatggccaggattccttctcccctggtttttgaggatccctgggtcttctgagactggccaggagagggatggtggggccagtggttgtgtgaaagcaggaggggcagccctcctggacaagtgtgatccccctataaacggctctcaggaggttagtgagtaggagattctgccttgttctgatgagcctgtgcaggggctccaggggagcatgctgtccagggggcacagaagggtggtgagtgtgatcaaatctagtctcactcccactttttagtctcactcctacttttgtccaccacccctgcctcctggatcttctcccactttttttttcagctttaggacctggggagatcctgtgagtcaaggcagacacccaatcctgcccccacactcggggtcctccaagaggttggggggcagagtcccagagcagccctttaccccaggtccaggccctggaatcctgagactcgcgtttccttggccagtggtaacacaggacgtgtgtgcgcatgtgcaagtgtggatgtatgtgtgtgcgtgtgttttgctcatttctttagggaacttgggagtcggggttggaggtgctgggcaatggaacttcaaattcaatgtcgcccagcagtgaggggagtcgggaggtgaggcctgtaggccaaccaattggtggagtctcagcgatagcccaggtgagaagtggttcacccagaggggcagggtgggggcctcgggcagatctgtccctcttggcacctctgtcctcaaatgtccaaaatgttggaggacctctgttcatatcccacgcctgggctcttgccagcagtggagttactgtagagggatgtcccaagcttgttttccaatcagtgttaagctgtttgaaactctcctgtgtctgtgttttgtttgtgcgtgtgtgtgagagcacatcagtgtgtgcaggctgtgtttccccatttctctcctcccttcagacccatcattgagaacaaatgtaagaaatcccttcccaccaccctccctgcctcccaggccctctgcgggggaaacaagatcacccagcatccttccccaccccagctgtgtatttatatagatggaaatatactttatattttgtatcatcgtgcctatagccgctgccaccgtgtataaatcctggtgtatgctccttatcctggacatgaatgtattgtacactgacgcgtccccactcctgtacagctgctttgtttctttgcaatgcattgtatggctttataaatgataaagttaaagaaaactctgtgccgttatctatctgtgttgttcggacaggggtctgccatgtctctggtgggcaaaaaggggcctctccagagatccaggtgggcttcagcgatgcctctagtggacagctcaaatcctcccagcggcctccccaccatctgcgtggtggttctggttccctgtgtttattcatttggactctttcagctgcaagagaaa

SEQ ID NO: 339 - DNA, 7428 bp, Homo sapiens
agtgctagcgctcctctccagcatgctgcggcggggcagccaggcgctccggcgcttctccactggccgggtttatttcaaaaacaagctgaagttggcactaattggccagagcctctttggacaagaagtctatagccacctccgcaaagagggccaccgagtagtaggggtgttcacagttccagacaaggatggaaaagctgaccctctggctttggctgcagagaaagatgggacccctgtgttcaagcttcctaaatggagggtcaagggcaagaccatcaaagaagtggcagaagcctacagatccgtgggtgcagagctaaatgtgctccctttctgcactcagttcattcccatggatataattgatagtccaaagcacggctctatcatttatcacccatccatcctgcccaggcacagaggagcctctgctatcaattggactctaattatgggagataagaaagctgggttttctgttttctgggctgatgatggcttggatacaggacccatccttcttcagagatcatgtgatgttgaacccaatgatacagtggatgcactttataatcggtttctttttcctgaaggaatcaaggccatggtagaagctgtccaactcatagctgatggaaaagctcctcgtataccccagccagaagaaggggcaacatatgaaggtatccagaaaaaggaaaatgctgagatttcttgggaccagtctgccgaagttttacataactggattcgaggtcatgataaagtccctggagcttggacagagataaatggacagatggtcactttctatggctcgacattactgaatagctctgtgcctcctggagaaccactggaaattaaaggtgccaagaagcctggtctcgttaccaaaaatggacttgttctttttggtaacgatggaaaagcactgacggtgagaaatctgcagtttgaagatggaaaaatgatccctgcctctcagtacttttcaacgggtgagacgtcagtggtagaactgacagctgaagaggtgaaagtggcagagaccatcaaggtcatctgggctggaattttaagcaatgtccccattattgaagactcaacagacttctttaaatctggagcaagctcaatggatgttgccaggctggttgaagagatcagacagaaatgtggtgggcttcagttgcagaatgaagatgtctatatggccaccaagtttgaaggctttatccaaaaggtcgtgaggaaactgagaggagaagatcaagaggtggagctggttgtagattatatttcaaaggaggtcaatgaaatcatggtaaaaatgccataccagtgtttcataaatggacagttcacagatgcagacgatggaaagacttacgacactatcaacccaacagatggatctacaatatgcaaagtatcctacgcttctttggcggatgttgataaagcagtagcagcagcaaaagatgcttttgaaaacggtgaatggggaagaatgaatgcaagagaaagaggaagattgatgtatagacttgcagacctactggaagagaaccaagaagagctggcaactattgaagcccttgattcaggggctgtctataccttggccctgaagacacacattggaatgtctgtgcaaacattcagatattttgctggctggtgcgacaaaattcagggttctactattccaatcaaccaggcccgtccaaatcgcaatctgaccttcaccaagaaagagccactcggtgtctgtgccattattattccctggaactacccgctgatgatgctggcatggaagagtgctgcgtgtttggcagcaggcaataccttagtgctcaagccagcacaggtcacgcccttgactgctttgaagtttgcagaactgtctgtgaaagcaggctttccaaagggggtcatcaacatcattccaggctcaggtggcatagcaggacaacgtctgtctgaacatcctgacatccgcaaacttggtttcactggatccactcctattggcaaacagatcatgaagagctgtgctgttagcaacttgaagaaagtttcccttgagcttggtggcaagtctccacttataatatttaatgactgtgaacttgacaaggctgtgcgaatgggcatgggagcagtatttttcaacaaaggagagaactgtattgctgctgggcggttgttcgtggaagaatccatccacgacgaatttgtgacaagagtggtagaagaaattaaaaagatgaaaattggtgatccacttgacagatccactgatcatgggccccaaaatcataaggctcatctggaaaagctgctgcaatactgtgaaactggagtgaaagaaggggccactttggtgtacgggggaagacaagtccaaaggccaggctttttcatggagccgaccgtgttcacagatgtggaagactacatgtacctcgccaaagaggaatcctttgggcctattatggtcatttctaaattccaaaatggggacatcgatggagtgttgcagcgagcaaatagtacagagtatggtttggcctcaggggtttttacaagagacataaacaaagctatgtatgtgagtgaaaaactggaagcaggaactgtttttattaacacatacaacaagacagatgtggcggccccatttggcggagttaaacaatctggctttggaaaagacttaggtgaggaagctctaaatgaatatctcaaaaccaagacggtgacactggaatattagagcaacaccatcatcaggaaagccttgacagacagccctttacaactctggacacacttaagaagattgggtgtgttgaggcaggaggtgtcagccacaaaccaaaaaatacacagatggaccatgaagagggccaggccatgttaaagcatttacacatgtgcctgagtattttctaatacaccttccagtgatttggagttgttgcattttgactatgttgtatatcatacgtatttctaaaataccaagctgtttctcccctacctagacaaatctattcatggttcccatcttgaagatgtcagtaccatgcagttataatacacaaggtgcatttattggaaactttgtataatatgtacaggtttttaacctctgaactatacatagggggttattaaaaagattttctataagtcttctaaggaacagtataacctgtaaggaatgtgaaggtagttcttttttagtatttggaaataagatacatctttgtgcctttgatattccattttttaacccactgtgatgggtgatcaacctagaaacattatcttgagtacctactaggtaccaggtactatattatgttctgaggagtatagagaatttaatgatatgatggctggcccccacatagtttaaattttagtaaatagcttttgaagcaaattttacatatgatatagtagaaggctgatcctggtcgtatcataccatcttcctatctatgtaactttgggaaactctcgcaactcctctgagcctctgcttccctatgtgtaaaacagggatagtaaatgccttcctcaggacccttaataggagaattcattgcagtaatgtaagtaaagcacctcacattaatgctttgctcatggtaagtactcaaatttaactctgatttcctccgtcaccattcttaaaagatattgagatagtttaattaactagatgaattcatttcccacaacccttttcaatcatcaattcctagatatttttctcatccattgttctgacacaatgcctgatacagcagcactgaaaaatgccacacaatgaaaaatggcaatagtacaaggaaaaggggtgcttttctttgggcagctcgctcgtccttcatgggacatcttactttccatttttctacctattggttctgctgttcactggctgtgtgatcttgggcaagatagtaatctaatatctcagagcctaggttgagtatctataaaatgaaaatcaaatctctatctcagtaggtgttgcaaggattcagtgagataatatacataatgcacttaacaaggcgtttggaccatagcattgaagaaatggaaactattaacagcccatttcccattggcagacagaagtagtcaggtgagtaaattttcaccatctatgtgtgactagaaggcggcaaatttctgaatcacatgagtctccaaaagatagccagaaagttaaattctattaatcctcctttaaaaataaaatttcagtaaacattcctttttctttggctttgaagaagccttagggaatatttgtcattttggagacttggcagaataacatgaggggattgtagggaatcaataaaaactaaacaacaaaatcagagtcagagaacattttcaaaaggaagaataggaggtttgatcccagcatgataaacagagcgaatttggcctggaagcacttttgattatactatagctcatttaccatcccagagtttggcacagctgaaattttaagttggaatgaatattcactgggcccaaaatgacagttcatatttgaataaaagtgacaaaagcctttttataagtaatcacttttaagtgaaatgttttaactgatttcatgtgatttagaatatgatttaatcaaattattttaatgatagatggaatggcagacaaaaacatgcctgtccttctagactgattttactttaccctctaatattcatctcagtagcagtgttttaaatattctctgggctgcaaaactctttgggaatctgataaaagctatgaacactccctgtgtcccgcttctacccccaaaattcatgtgcacacacacaattctgcaagtatcttcaaagggttcacagacctcccaaaggccatgcttgggccccagattaagaactcctttctccatagcaagttttaaacatttcttaccagcttacatttttagatctggctgatcagaatcaaaggctctgtgtaatacataaagttaccaagtgaactggaattggaacatcaccctccccagcctgctaggtgatttacttaacacatagagtaataaaatcatcgctgttgctttagatcacggattattttgctaataatgctaaggatgaagctgtgatcttattatcacctgaatcgggaggtgtggacactttaagcagttccactttccttctaattccccatccccatgcctttgctaaagctgtcccttttgctctaacacccttcctggaccttcctaccctagctgggctaagtgtttctcctcagcgttcccacttgtttcaaacatagcacttaccacttgtactaaaattacttgccttcttaattagatatgaacaaccctccccaactccagtatgggccttctgtcaataataatacgatatgacagctaccatttattaagggcctcctgtatgaaagaccttaggctaagcatgttttaaatgttatttaatcttcacaatctctgaaaaaaatgaagaaatcaacgtgcttttcttactacctctacccctaagccattattacttttttttttttttgagacagagttttgctcttgttgcccaggctgcagtgcagtggtgcaatcttggctcactgcaacctctgcctcttgggttcaagcgattgtcatgccttagccttccaagtagctgggattacaggtgtgtgccactacacctggctaagtagagatggggtttcgccatgttggccaggctggtcttgaactcctgacctcaagtgatccacctgcctccgcctcccaaagtgctgggattacaggcatgaaccactgcacctggcctgttacctctttcctacaattttgctcaagtctcccaactggtcttctggattcctctcttctgcggtcctgttcaaagcttaagtcagacagtgtcacttcactcgtctgtttaaaacctttcaatggcccccatttcacgtagaccaaagtccaacgtatttacctggcctactgatcttgctcctagctacctctgacctcatctcctgtcaatttccctctcattctgttccaccatcctgactgccttgacttcctcaacagaacaagcctgctcctgcctcagggcctctgtccttattcttcctcttcccaggggtgtgctggtaaaatatttaacaaatagttctccgggacgggggagaaaaccctcatttgtagcatttgcaggtatctatgtgtaaatactctcatcaaggctatttttgagccactaatttgccttcactgaatacagagtttgggaagagatgcatgccatcagaacaaatgcaagccagcaccagcacaccactgcctcttcctgcaactcttgtccatacacaacctcatggctggctggctcacttcctgcaggtctctcctcaaatatcatctgatgagagacacattccctgactatgctttctaaaataggccatatgcccccacattcataccccatctgctgtcattctttattctttttataagtgcattattttcatagcacttatcactacctgttgtatattaatcaatgatcttttcccattagaatgtaagtttcatgaacaggtacttgttttaatactgtatctccagtcctaatgtgtaacaggagcccaataaatgtttgctttcaaatggagaggttaagtaacctgctcaaatcacacagctattaagtggcagaacaggttttcaagcaatgcatctggtggttttaactaagtcgagatagtttttattcctaatgcctaaatcagggcctaggtagtgagctgtgggcacatattaagtattggttaaactaaaaataataagcaaaatggacattatctataaaagcttttgtggaaatggctagagctagggtaaggaaacaaatttggttccccatacctgccctccaagaaaataaagctgtcaaggaaaatctgggctaagagtaggatatgagggatgatggataaggcatgagacatgagaaataagggggattaaattattattactattatacaaatgatgcctgagtagatttttaaaatgattaaatacccaatgatgtaaaaaacatttataaaataggaaagtaagactgactcaaccataatttgttgagtcaacccaaaaatctatttggttattttcaaacagaaatagcctacagatgatatctgagattgttccaaactttttctatgaatatgtatactttttttacataattaacataatactgtatattaatttgttacctgctttttcaattaacaatatatcataagcatctatgccaataaacacaattctgcata

SEQ ID NO: 340 - DNA, 2889 bp, Homo sapiens
gcggttgctgctgggctaacgggctccgatccagcgagcgctgcgtcctcgagtccctgcgcccgtgcgtccgtctgcgacccgaggcctccgctgcgcgtggattctgctgcgaaccggagaccatggccaaaccagcacagggtgccaagtaccggggctccatccatgacttcccaggctttgaccccaaccaggatgccgaggctctgtacactgccatgaagggctttggcagtgacaaggaggccatactggacataatcacctcacggagcaacaggcagaggcaggaggtctgccagagctacaagtccctctacggcaaggacctcattgctgatttaaagtatgaattgacgggcaagtttgaacggttgattgtgggcctgatgaggccacctgcctattgtgatgccaaagaaattaaagatgccatctcgggcattggcactgatgagaagtgcctcattgagatcttggcttcccggaccaatgagcagatgcaccagctggtggcagcatacaaagatgcctacgagcgggacctggaggctgacatcatcggcgacacctctggccacttccagaagatgcttgtggtcctgctccagggaaccagggaggaggatgacgtagtgagcgaggacctggtacaacaggatgtccaggacctatacgaggcaggggaactgaaatggggaacagatgaagcccagttcatttacatcttgggaaatcgcagcaagcagcatcttcggttggtgttcgatgagtatctgaagaccacagggaagccgattgaagccagcatccgaggggagctgtctggggactttgagaagctaatgctggccgtagtgaagtgtatccggagcaccccggaatattttgctgaaaggctcttcaaggctatgaagggcctggggactcgggacaacaccctgatccgcatcatggtctcccgtagtgagttggacatgctcgacattcgggagatcttccggaccaagtatgagaagtccctctacagcatgatcaagaatgacacctctggcgagtacaagaagactctgctgaagctgtctgggggagatgatgatgctgctggccagttcttcccggaggcagcgcaggtggcctatcagatgtgggaacttagtgcagtggcccgagtagagctgaagggaactgtgcgcccagccaatgacttcaaccctgacgcagatgccaaagcgctgcggaaagccatgaagggactcgggactgacgaagacacaatcatcgatatcatcacgcaccgcagcaatgtccagcggcagcagatccggcagaccttcaagtctcactttggccgggacttaatgactgacctgaagtctgagatctctggagacctggcaaggctgattctggggctcatgatgccaccggcccattacgatgccaagcagttgaagaaggccatggagggagccggcacagatgaaaaggctcttattgaaatcctggccactcggaccaatgctgaaatccgggccatcaatgaggcctataaggaggactatcacaagtccctggaggatgctctgagctcagacacatctggccacttcaggaggatcctcatttctctggccacggggcatcgtgaggagggaggagaaaacctggaccaggcacgggaagatgcccaggtggctgctgagatcttggaaatagcagacacacctagtggagacaaaacttccttggagacacgtttcatgacgatcctgtgtacccggagctatccgcacctccggagagtcttccaggagttcatcaagatgaccaactatgacgtggagcacaccatcaagaaggagatgtctggggatgtcagggatgcatttgtggccattgttcaaagtgtcaagaacaagcctctcttctttgccgacaaactttacaaatccatgaagggtgctggcacagatgagaagactctgaccaggatcatggtatcccgcagtgagattgacctgctcaacatccggagggaattcattgagaaatatgacaagtctctccaccaagccattgagggtgacacctccggagacttcctgaaggccttgctggctctctgtggtggtgaggactagggccacagctttggcgggcacttctgccaagaaatggttatcagcaccagccgccatggccaagcctgattgttccagctccagagactaaggaaggggcaggggtggggggaggggttgggttgggctcttatcttcagtggagcttaggaaacgctcccactcccacgggccatcgagggcccagcacggctgagcggctgaaaaaccgtagccatagatcctgtccacctccactcccctctgaccctcaggctttcccagcttcctccccttgctacagcctctgccctggtttgggctatgtcagatccaaaaacatcctgaacctctgtctgtaaaatgagtagtgtctgtactttgaatgagggggttggtggcaggggccagttgaatgtgctgggcggggtggtgggaaggatagtaaatgtgctggggcaaactgacaaatcttcccatccatttcaccacccatctccatccaggccgcgctagagtactggaccaggaatttggatgcctgggttcaaatctgcatctgccatgcacttgtttctgaccttaggccagcccctttccctccctgagtctctattttcttatctacaatgagacagttggacaaaaaaatcttggcttcccttctaacattaacttcctaaagtatgcctccgattcattcccttgacactttttatttctaaggaagaaataaaaagagatacacaaacacataaacaca

SEQ ID NO: 341 - DNA, 3113 bp, Homo sapiens
gaattctctcccgccgtgtcccctcgacccgcccaacttgtgcctccctccccttcccctctggggtcctgcccacctccctgcagggagctgggctgttttaaggactccgggtggggcgagaggccgggaaagcagaggagagagaaattaggaggcgggagaaatccagggcaagaaggaagaggggagtcagaggatggtagagagcactttttggaagctgccacgccgcgtctcaggctggccgggctgagctggggaagagggagcaaaggcggcgcagggcctgcgcttaggcagcgggaggcagctcggcgcgggcctgacctccccagagcgccccgctgcggccgagcagatccggcccagccgtccggcagccagtcccggaccagacactggaccgtccccggggggcgctgaactccctcgcagcatccgagccggcgggccggtggtgcgccctgggcgcgcgaggtggtgaggccccaggagcccggcgcgccgggacgcgcgggccggcttggcgatgcacaccctcactggcttctccctggtcagcctgctcagcttcggctacctgtcctgggactgggccaagccgagcttcgtggccgacgggcccggggaggctggcgagcagccctcggccgctccgccccagcctccccacatcatcttcatcctcacggacgaccaaggctaccacgacgtgggctaccatggttcagatatcgagacccctacgctggacaggctggcggccaagggggtcaagttggagaattattacatccagcccatctgcacgccttcgcggagccagctcctcactggcaggtaccagatccacacaggactccagcattccatcatccgcccacagcagcccaactgcctgcccctggaccaggtgacactgccacagaagctgcaggaggcaggttattccacccatatggtgggcaagtggcacctgggcttctaccggaaggagtgtctgcccacccgtcggggcttcgacaccttcctgggctcgctcacgggcaatgtggactattacacctatgacaactgtgatggcccaggcgtgtgcggcttcgacctgcacgagggtgagaatgtggcctgggggctcagcggccagtactccactatgctttatgcccagcgcgccagccatatcctggccagccacagccctcagcgtcccctcttcctctatgtggccttccaggcagtacacacacccctgcagtcccctcgtgagtacctgtaccgctaccgcaccatgggcaatgtggcccggcggaagtacgcggccatggtgacctgcatggatgaggctgtgcgcaacatcacctgggccctcaagcgctacggtttctacaacaacagtgtcatcatcttctccagtgacaatggtggccagactttctcggggggcagcaactggccgctccgaggacgcaagggcacttattgggaaggtggcgtgcggggcctaggctttgtccacagtcccctgctcaagcgaaagcaacggacaagccgggcactgatgcacatcactgactggtacccgaccctggtgggtctggcaggtggtaccacctcagcagccgatgggctagatggctacgacgtgtggccggccatcagcgagggccgggcctcaccacgcacggagatcctgcacaacattgacccactctacaaccatgcccagcatggctccctggagggcggctttggcatctggaacaccgccgtgcaggctgccatccgcgtgggtgagtggaagctgctgacaggagaccccggctatggcgattggatcccaccgcagacactggccaccttcccgggtagctggtggaacctggaacgaatggccagtgtccgccaggccgtgtggctcttcaacatcagtgctgacccttatgaacgggaggacctggctggccagcggcctgatgtggtccgcaccctgctggctcgcctggccgaatataaccgcacagccatcccggtacgctacccagctgagaacccccgggctcatcctgactttaatgggggtgcttgggggccctgggccagtgatgaggaagaggaggaagaggaagggagggctcgaagcttctcccggggtcgtcgcaagaaaaaatgcaagatttgcaagcttcgatcctttttccgtaaactcaacaccaggctaatgtcccaacggatctgatggtggggagggagaaaactgtcctttagaggatcttccccactccggcttggccctgctgtttctcagggagaagcctgtcacatctccatctacagggagttggagggtgtagagtcccttggttgaacagggtagggagcctggataggagtgggtgggaataaaccagactgggatgcctgtgtctcagtcctgcctcctcacggacttgctctgtgacctcaggtgacccacatgagcttttagcctcagtttcctcatctgtaaaatgagctctaatgactttgtgactctttggtgtggccctggagcctggggccacggtggagttcctggccggccttgccacttgacaactcctttaaggcttcccccttaacacgggatccctgtggtggtgtttgggagttgcctggaggcaactccaagcctggcccccagctgaagcatggcaatctggctgctctctacagggacccccaagcgctgtgggtggagggcaggggtcgggggggttgaccttcttgggtcttcacatggcctaggccagtcctccggtcagactggtgtcaggcaccgtggtgcaaaattcctcttctggcccctccagtacccagagaaactggctgggccattaactgctgcagcaccaagggtggtagaaagagctgtgaagagcccccaaaccagtaccaggacacctgggttctcctgtgacctggggcacagttcttgccctctaggccttgatttccccacctgcaagtggggatgccagccctggctctgcctccttcatgaggctctggaagactggccaaggttgtggaggagcttgtgaacttgattaaagtgtcgtaacatggaa

SEQ ID NO: 342 - DNA, 3490 bp, Homo sapiens
actgggtagaatacttggggtgccagggaggcattaatgcgagaggagtcaggtgctcagtttttattggagttgggagggcagccccacatcaggaagagaacctgtttctgcaggatggtccggggagaagggaggactccacccaggcttgtgtttgccctgctctgtgtattcagccagcaggctctgcacaaggaagcaaagtgcagggagccaggctccaccgacagccaggcactgggcagcacgcactggagacccaggaccctgtgcaggagcagctccgggtgacacgaggggactgaagatactcccacaggggctcagcaggagcaatgggtaaccaaatgagtgttccccaaagagttgaagaccaagagaatgaaccagaagcagagacttaccaggacaacgcgtctgctctgaacggggttccagtggtggtgtcgacccacacagttcagcacttagaggaagtcgacttgggaataagtgtcaagacggataatgtggccacttcttcccccgagacaacggagataagtgctgttgcggatgccaacggaaagaatcttgggaaagaggccaaacccgaggcaccagctgctaaatctcgttttttcttgatgctctctcggcctgtaccaggacgtaccggagaccaagccgcagattcatcccttggatcagtgaagcttgatgtcagctccaataaagctccagcgaacaaagacccaagtgagagctggacacttccggtggcagctggaccggggcaggacacagataaaaccccagggcacgccccggcccaagacaaggtcctctctgccgccagggatcccacgcttctcccacctgagacagggggagcaggaggagaagctccctccaagcccaaggactccagcttttttgacaaattcttcaagctggacaagggacaggaaaaggtgccaggtgacagccaacaggaagccaagagggcagagcatcaagacaaggtggatgaggttcctggcttatcagggcagtccgatgatgtccctgcagggaaggacatagttgacggcaaggaaaaagaaggacaagaacttggaactgcggattgctctgtccctggggacccagaaggactggagactgcaaaggacgattcccaggcagcagctatagcagagaataataattccatcatgagtttctttaaaactctggtttcacctaacaaagctgaaacaaaaaaggacccagaagacacgggtgctgaaaagtcacccaccacttcagctgaccttaagtcagacaaagccaactttacatcccaggagacccaaggggctggcaagaattccaaaggatgcaacccatcggggcacacacagtccgtgacaacccctgaacctgcgaaggaaggcaccaaggagaaatcaggacccacctctctgcctctgggcaaactgttttggaaaaagtcagttaaagaggactcagtccccacaggtgcggaggagaatgtggtgtgtgagtcaccagtagagattataaagtccaaggaagtagaatcagccttacaaacagtggacctcaacgaaggagatgctgcacctgaacccacagaagcgaaactcaaaagagaagaaagcaaaccaagaacctctctgatggcgtttctcagacaaatgtcagtgaaaggggatggagggatcacccactcagaagaaataaatgggaaagactccagctgccaaacatcagactccacagaaaagactatcacaccgccagagcctgaaccaacaggagcaccacagaagggtaaagagggctcctcgaaggacaagaagtcagcagccgagatgaacaagcagaagagcaacaagcaggaagccaaagaaccagcccagtgcacagagcaggccacggtggacacgaactcactgcagaatggggacaagctccaaaagagacctgagaagcggcagcagtcccttgggggcttctttaaaggcctgggaccaaagcggatgttggatgctcaagtgcaaacagacccagtatccatcggaccagttggcaaatccaagtaaacaaatcagcacggttcccaccaggttctcctgccaccaagatgtgttctccttactccatctcctccccaaacacgctccatgtatatattcttctgatggccagcaaatgaaattctgcctagaaattaagcccgagctgttgtatattgaggtgtattatttacgtctctggtccagtcttttctggcaaataacagtaaagatggtttagcaggtcacctagttgggtcagaagagtcgatgatcaccaagcaggaaagggagggaatagaggaatgtgttcgggttaagtgatgaaaatggcagtggtggccgggcgtggtggctctcgcctgtaatctcagcactttgggaggccgaggcaggtggatcacctgaggtcaggagttcaagactagcctggccaacatcatgaaaccccgtctctactaaaaatacaaaaattagccaggcatggtggcacacacctgtagtcccagctactcgggagcccaacgcacgagaaccgcttgtacccaggaggtggaggttgcagtgagccgaagttgcaccattgcactccaccctgggcgacagagcaagattctatcaaaaaaaaaaaaaggcagtggcaagtaagttatagaagagaaatgctgctagaaggaattaagcgttgtagtaaatgcgtgcttatcctctaagcttgaagaagggagacgaaaatccatttgtttaaattcacatctcaaggagggagaacccgggctgtgttgggtggttgccaatttcctagaacggaatgtgtggggtatagaaaaaggaatgaataagcgttgtttttcaaatagggtccttgtaagttattgatgagagggaaaagattgactggggagggcttaaaatgatttgggaaaacaattgcttttgaggctcagtgacaacggcaaagattacaacttaaaaaaaaaaaataaataaaaaataaaggaagttgcacggttattttgcaacacaagggggcggcaaggtccccatttttatcctgtaatactgtatccctaacaaagatttggtctctgctatcttacattattaatgtttctcagatggctgaggggctcgcttcatctgttccgtctgacacttatctcaagtgtgtctgtcattcctaatgttctcaggatgtgctctgataaaaccctccccataacctcagttaataaaaatttacagaagacttctcaaatacctgagttgtttttaatacctgtacaaaggagtaaataggaccctgagtctattaaaatgtaattcaaagtagcatatgattgactgacagtcatgtaaactgtatctttctttttctgatttaataaaaaatacatttacttctaaagtaaaaaaaaaaaaaa

SEQ ID NO: 343 - DNA, 4579 bp, Homo sapiens
acttcgccgggtcgcgccccgacggccggagcgtggatgcggcggcgcccgccgagccggggcggacgcggggcggcccgggcccgggagacgcgccggcagccccggcaccgcagcggtcgcaggatggccgaggctatcagctgtactctgaactgtagttgccaaagtttcaaacccgggaaaataaaccaccgtcagtgtgaccaatgcaagcatggatgggtggcccacgctctaagtaagctaaggatcccccccatgtatccaacaagccaggtggagattgtccagtccaatgtagtgtttgatattagcagcctcatgctctatgggacccaggccatccccgttcgcctaaaaatcctactggaccggctcttcagtgtgttgaagcaagatgaggttctccagatcctccatgccttggactggacacttcaggattatatccgtggatacgtactgcaggatgcatcaggaaaggtgttggatcactggagcatcatgaccagtgaggaagaagtggccaccttgcagcagttccttcgttttggagagaccaaatctatagttgaactcatggcaattcaagagaaagaagagcaatccatcatcataccaccttccacagcaaatgtagatatcagggctttcatcgagagctgcagtcacaggagttctagcctccccactcctgtggacaaaggaaaccccagcagtatacacccctttgagaacctcataagcaacatgactttcatgctgcctttccagttcttcaaccctctgcctcctgcactgatagggtcattgcccgaacaatatatgttggagcagggtcatgaccaaagtcaggaccccaaacaggaagtccatgggcccttccctgacagcagcttcttaacttccagttccacaccatttcaggttgaaaaagatcagtgtttaaactgtccggatgctattactaaaaaagaagacagcacccatttaagtgactccagctcatacaacattgtcactaagtttgaaaggacacagttatcccctgaggccaaagtgaagcctgagaggaatagccttggtacaaagaagggccgggtgttctgcactgcatgtgagaagaccttctatgacaaaggcaccctcaaaatccactacaatgccgtccacttgaagatcaagcataagtgcaccatcgaagggtgtaacatggtgttcagctccctaaggagccggaatcgccatagcgccaaccccaaccctcggctgcacatgccaatgaacagaaataaccgggacaaagacctcaggaacagcctgaacctggccagctctgagaactacaagtgcccaggtttcacagtgacgtccccagactgtaggcctcctcccagctaccctggttcaggagaggattccaaaggccaaccagccttcccaaacattgggcaaaatggtgtgctttttcccaacctaaagacagtccagccagtccttcctttctaccgcagtccagccacgcctgccgaggtagcaaacacgcctgggatactcccttccctcccgctgttgtcctcttcaatcccagaacagctcatttcaaacgaaatgccatttgatgcccttcccaagaagaaatccaggaagtccagtatgcctatcaaaatagagaaagaagctgtggaaatagctaatgagaaaagacacaacctcagctcagatgaagacatgcccctacaggtggtcagtgaagatgagcaggaggcctgcagtcctcagtcacacagagtatctgaggagcagcatgtacagtcaggaggcttagggaagcctttccctgaaggggagaggccctgccatcgtgaatcagtaattgagtccagtggagccatcagccaaacccctgagcaggccacacacaattcagagagggagactgagcagacaccagcattgatcatggtgccaagggaggtcgaggatggtggccatgaacactacttcacacctgggatggaaccccaagttcctttttctgactacatggaactgcagcagcgcctgctggctgggggactcttcagtgctttgtccaacaggggaatggcttttccttgtcttgaagattctaaagaactggagcacgtgggtcagcatgcattagcaaggcagatagaagaaaatcgcttccagtgtgacatctgcaagaagacctttaaaaatgcttgtagtgtgaaaattcatcacaagaatatgcatgtcaaagaaatgcacacatgcacagtggagggctgtaatgctacctttccctcccgcaggagcagagacagacacagctcaaacctaaacctccaccaaaaagcattgagccaggaagcattggagagtagtgaagatcatttccgtgcagcttaccttctgaaagatgtggctaaggaagcctatcaggatgtggcttttacacagcaagcctcccagacatctgtcatcttcaaaggaacaagtcgaatgggcagtctggtttacccaataacgcaagtccacagtgccagcctggagagctacaactctggccccttgagcgagggcaccatcctggatttgagcactacctcgagcatgaagtcagagagtagcagccattcttcctgggactctgacggggtgagtgaggaaggcactgtgcttatggaggacagtgatgggaactgtgaagggtcgagccttgtccctggggaagatgagtaccccatctgtgtcctgatggagaaggctgaccagagccttgctagcctgccttctgggttgcccataacctgtcatctctgccaaaagacatacagtaacaaagggacctttagggcccactacaaaactgtgcacctccggcagctccacaaatgcaaagtaccaggctgcaacaccatgttttcgtctgttcgcagtcgaaacagacacagccagaatcccaacctgcacaaaagcctggcctcatctccaagtcacctccagtaacaagatggcaaaccaagtatgctcagataagcttttttcataattcaggaataaagtagtccatagaaatgtttctgtttcatatcatttggggcgagtcaggcaaaagtatttgatttgactttatagttttccacagcacaatgagcaaaagacaaacctcgtgggaagatgacactggggcagcccttcctattatttttcttagcccaagaggtctttcactgatacaaggaaaacttgcagaaatgtgatttttcccagatttgtttacatgttccctgggacagatccaggtctgcagatcgacaccagtgggcccaggacctgggggtggctttaaatgaggcttgcagtgttaaaggtcttggataagaagggtcctggggaagaagactctgtggacaagataccagtccccaaaacagcattttcagttccttcttcaattagtttgaaatccagacctgagtttggaagactgattttttgagaccatccctgtgtttggagtggataattgtccctcccctcagccctgcaccagaggtctcatatgttaccccagggagttctcagaggattgggttggcctctaacatgttccttgttaattcttgttctgtaacatgcattcaagaagctaggggaaaaatatctcatgcacttaaataatggtcttcaatttaatttaaaaatattttgacaatatttaatttgtgcttatgtggtgtttggtgtgagtgcagatattgcactgtgtcacctctggatctctgctcagaagcagaacaagtgatgacctaaatgtcaaaatcactgctcgttttcatttggtgaacttcaaactctgttctttttggtcacctgtggaatgaatgcaagcatgattttggcaggaacatttgtacatattctgccgtagataatgtggttctgatggttgttgtgtattttcagtatcactggatccctcagtcttcaccgttttataaacgtataagattaggatgaacttttgaatttacttggtaggaaaaaaagtaggacattattgccatattgtatgtcttaatatttaacttattcggaaatatattccacactgttacatacattttccatggtagaaaggaagttcagtcagtcctgtggaatgaaaccatctcctaaaattcagcatttgcagcattctaaaagcctgtgtaggtacaaggacattgattttgtattcagaattcaagttaactatcttttaaattcgtggttgatgtaagtaataaaaaacattcttaaagttgagggttataagagagattatttctgtggtctaaaggttaaaaagccaacaacctgttaccaattatttcagctttttttgttttaataagtgtgacaacttaaaacttgtttctatttaaagtgaaatgtatctttcaactgtttagttacccagctgtttaatattccagtcttcccaaagtgaaaagatttgtatacaaatgttttctatgatttaataaaaatatatggcacaccttttgtttaaaaaggcaaa

SEQ ID NO: 344 - DNA, 825 bp, Homo sapiens
acttctgcagcacagctcccttcccaggacgtgaaaatctgccttctcaccatgaggcttctagtcctttccagcctgctctgtatcctgcttctctgcttctccatcttctccacagaagggaagaggcgtcctgccaaggcctggtcaggcaggagaaccaggctctgctgccaccgagtccctagccccaactcaacaaacctgaaaggacatcatgtgaggctctgtaaaccatgcaagcttgagccagagccccgcctttgggtggtgcctggggcactcccacaggtgtagcactcccaaagcaagactccagacagcggagaacctcatgcctggcacctgaggtacccagcagcctcctgtctcccctttcagccttcacagcagtgagctgcaatgttggagggcttcatctcgggctgcaaggaccctgggaaagttccagaactccacgtccttgtctcaattgtgccatcaactttcagagctatcatgagccaacctcaccccacagggcctcagtcgccaccatgtgggcctctccagtgcaaaccaccgagcattccaccatgaccggtcacagctacaaatccagagaccatcaatcctgctagagtgcagggtggcaagcacccaagggtggctgaccaagactgcagagtctcctccatcttcaggtccattcagcctcctggcatttaactaccagcatccagtggtccccaaggaatcccttcctagcctcctgacatgagtctgctggaaagagcatccaaacaaacaagtaataaataaataaataaactcaatgcagacaca

SEQ ID NO: 345 - DNA, 3298 bp, Homo sapiens
gtctcctgcgagagccgcgggggccgcggagctggagccggagctgaagccggagccgggttggagtctgggcgggggccgggccggagcgggctccagagacatggggtcgaccgactccaagctgaacttccggaaggcggtgatccagctcaccaccaagacgcagcccgtggaagccaccgatgatgccttttgggaccagttctgggcagacacagccacctcggtgcaggatgtgtttgcactggtgccggcagcagagatccgggccgtgcgggaagagtcaccctccaacttggccaccctgtgctacaaggccgttgagaagctggtgcagggagctgagagtggctgccactcggagaaggagaagcagatcgtcctgaactgcagccggctgctcacccgcgtgctgccctacatctttgaggaccccgactggaggggcttcttctggtccacagtgcccggggcagggcgaggagggcagggagaagaggatgatgagcatgccaggcccctggccgagtccctgctcctggccattgctgacctgctcttctgcccggacttcacggttcagagccaccggaggagcactgtggactcggcagaggacgtccactccctggacagctgtgaatacatctgggaggctggtgtgggcttcgctcactccccccagcctaactacatccacgatatgaaccggatggagctgctgaaactgctgctgacatgcttctccgaggccatgtacctgcccccagctccggaaagtggcagcaccaacccatgggttcagttcttttgttccacggagaacagacatgccctgcccctcttcacctccctcctcaacaccgtgtgtgcctatgaccctgtgggctacgggatcccctacaaccacctgctcttctctgactaccgggaacccctggtggaggaggctgcccaggtgctcattgtcactttggaccacgacagtgccagcagtgccagccccactgtggacggcaccaccactggcaccgccatggatgatgccgatcctccaggccctgagaacctgtttgtgaactacctgtcccgcatccatcgtgaggaggacttccagttcatcctcaagggtatagcccggctgctgtccaaccccctgctccagacctacctgcctaactccaccaagaagatccagttccaccaggagctgctagttctcttctggaagctctgcgacttcaacaagaaattcctcttcttcgtgctgaagagcagcgacgtcctagacatccttgtccccatcctcttcttcctcaacgatgcccgggccgatcagtctcgggtgggcctgatgcacattggtgtcttcatcttgctgcttctgagcggggagcggaacttcggggtgcggctgaacaaaccctactcaatccgcgtgcccatggacatcccagtcttcacagggacccacgccgacctgctcattgtggtgttccacaagatcatcaccagcgggcaccagcggttgcagcccctcttcgactgcctgctcaccatcgtggtcaacgtgtccccctacctcaagagcctgtccatggtgactgccaacaagttgctgcacctgctggaggccttctccaccacctggttcctcttctctgccgcccagaaccaccacctggtcttcttcctcctggaggtcttcaacaacatcatccagtaccagtttgatggcaactccaacctggtctacgccatcatccgcaagcgcagcatcttccaccagctggccaacctgcccacggacccgcccaccattcacaaggccctgcagcggcgccggcggacacctgagcccttgtctcgcaccggctcccaggagggcacctccatggagggctcccgccccgctgcccctgcagagccaggcaccctcaagaccagtctggtggctactccaggcattgacaagctgaccgagaagtcccaggtgtcagaggatggcaccttgcggtccctggaacctgagccccagcagagcttggaggatggcagcccggctaagggggagcccagccaggcatggagggagcagcggcgaccgtccacctcatcagccagtgggcagtggagcccaacgccagagtgggtcctctcctggaagtcgaagctgccgctgcagaccatcatgaggctgctgcaggtgctggttccgcaggtggagaagatctgcattgacaagggcctgacggatgagtctgagatcctgcggttcctgcagcatggcaccctggtggggctgctgcccgtgccccaccccatcctcatccgcaagtaccaggccaactcgggcactgccatgtggttccgcacctacatgtggggcgtcatctatctgaggaatgtggacccccctgtctggtacgacaccgacgtgaagctgtttgagatacagcgggtgtgaggatgaagccgacgaggggctcagtctaggggaaggcagggccttggtccctgaggcttcccccatccaccattctgagctttaaattaccacgatcagggcctggaacaggcagagtggccctgagtgtcatgccctagagacccctgtggccaggacaatgtgaactggctcagatccccctcaacccctaggctggactcacaggagccccatctctggggctatgcccccaccagagaccactgcccccaacactcggactccctctttaagacctggctcagtgctggcccctcagtgcccacccactcctgtgctacccagccccagaggcagaagccaatgggtcactgtgccctaaggggtttgaccagggaaccacgggctgtcccttgaggtgcctggacagggtaagggggtgcttccagcctcctaacccaaagccagctgttccaggctccaggggaaaaaggtgtggccaggctgctcctcgaggaggctgggagctggccgactgcaaaagccagactggggcacctcccgtatccttggggcatggtgtggggtggtgagggtctcctgctatattctcctggatccatggaaatagcctggctccctcttacccagtaatgaggggcagggaagggaactgggaggcagccgtttagtcctccctgccctgcccactgcctggatggggcgatgccacccctcatccttcacccagctctggcctctgggtcccaccacccagccccccgtgtcagaacaatctttgctctgtacaatcggcctctttacaataaaacctcctgctccaca

SEQ ID NO: 346 - DNA, 4367 bp, Homo sapiens
agtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccggggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaa

SEQ ID NO: 347 - DNA, 12301 bp, Homo sapiens
agccttctcactcctcactgagtccactctgaacgtgctaaaatgggaaggaggcggtgttttgctgatctgttaaattcttagtgaagtttccttgatttccagtggctgctgttgtttgagtttggtttggagcaaaactgaggtagtcctaacatttctgggactgaatccaggcaagagaaagaagaaaaagaagaagaaaaagaggaggaaaaaggtagggagaaataaagggaggagagaagcacagtgaaagaaaaaaaaagtcccttttcgacatcacattcctgtgttttccctcagcctggaaaacatattaatcccagtgcttttacgcccggaaacaaagagactaagccagactatgggggaaagggagataagaaggatcctggaactttaaagagggaaagagtgagattcagaaatcgccaggactggactttaagggacgtcctgtgtcagcacaagggactggcacacacagacacacgagaccgaggagaaactgcagacaaatggagatacaaagacttagaaggacagctcctttcacctcatcctacttgtccagaaggtaaaaagacacagccagaaagaaaaggcatcggctcagctctcagatcaggacaggctgtggatctgtggcggtactctgaaagctggagctgcagcacaccccttttgtattgctcaccctcggtaaagagagagagggctgggaggaaaagtagttcatctaggaaactgtcctgggaaccaaacttctgatttcttttgcaaccctctgcattccatctctatgagccaccattggattacacaatgacatggagaatgggaccccgtttcactatgctgttggccatgtggctagtgtgtggatcagaaccccacccccatgccactattagaggcagccacggaggacggaaagtgcctttggtttctccggacagcagtaggccagctcggtttctgaggcacactgggaggtctcgcggaattgagagatccactctggaggaaccaaaccttcagcctctccagagaaggaggagtgtgcccgtgttgagactagctcgcccaacagagccgccagcccgctcggacatcaatggggccgccgtgagacctgagcaaagaccagcagccaggggctctccgcgtgagatgatcagagatgaggggtcctcagctcggtcaagaatgttgcgtttcccttcggggtccagctctcccaacatccttgccagctttgcagggaagaacagagtatgggtcatctcagcccctcatgcctcggaaggctactaccgcctcatgatgagcctgctgaaggacgatgtgtactgtgagctggcggagaggcacatccaacagattgtgctcttccaccaggcaggtgaggaaggaggcaaggtgagaaggatcaccagcgagggccagatcctggagcagcccctggaccctagcctcatccctaagctgatgagcttcctgaagctggagaagggcaagtttggcatggtgctgctgaagaagacgctgcaggtggaggagcgctatccatatcccgttaggctggaagccatgtacgaggtcatcgaccaaggccccatccgtaggatcgagaagatcaggcagaagggctttgtccagaaatgtaaggcctctggtgtagagggccaggtggtggcggaggggaatgacggtggagggggagcaggaaggccaagcctgggcagcgagaagaagaaagaggacccaaggagagcacaagtcccaccaaccagagagagtcgggtgaaggtcctgagaaaactggccgccactgcaccagctttgccccaacctccctcaacccccagagccaccacccttcctcctgccccagccacaacagtgactcggtccacgtcccgggcggtaacagttgctgcaagacctatgaccaccactgcctttcccaccacgcagaggccctggaccccctcaccctcccacaggccccctacaaccactgaggtgatcactgccaggagaccctcagtttcagagaatctttaccctccatcccggaaggatcagcacagggagaggccacagacaaccaggaggcccagcaaggccaccagcttggagagcttcacaaatgcccctcccaccaccatctcagaacccagcacaagggctgctggcccaggccgtttccgggacaaccgcatggacaggcgggaacatggccaccgagacccaaatgtggtgccaggtcctcccaagccagcaaaggagaaacctcccaaaaagaaggcccaggacaaaattcttagtaatgagtatgaggagaagtatgacctcagccggcctactgcctctcagctggaggacgagctgcaggtggggaatgttccccttaaaaaagcaaaggagtctaaaaagcatgaaaagcttgagaaaccagagaaggagaagaaaaaaaagatgaagaatgagaacgcagacaagttacttaagagtgaaaagcaaatgaagaagtctgagaaaaagagcaagcaagagaaagagaagagcaagaagaaaaaaggaggtaaaacagaacaggatggctatcagaaacccaccaacaaacacttcacgcagagtcccaagaagtcagtggccgacctgctggggtcctttgaaggcaaacgaagactccttctgatcactgctcccaaggctgagaacaatatgtatgtgcaacaacgtgatgaatatctggaaagtttctgcaagatggctaccaggaaaatctctgtgatcaccatcttcggccctgtcaacaacagcaccatgaaaatcgaccactttcagctagataatgagaagcccatgcgagtggtggatgatgaagacttggtagaccagcgtctcatcagcgagctgaggaaagagtacggaatgacctacaatgacttcttcatggtgctaacagatgtggatctgagagtcaagcaatactatgaggtaccaataacaatgaagtctgtgtttgatctgatcgatactttccagtcccgaatcaaagatatggagaagcagaagaaggagggcattgtttgcaaagaggacaaaaagcagtccctggagaacttcctatccaggttccggtggaggaggaggttgctggtgatctctgctcctaacgatgaagactgggcctattcacagcagctctctgccctcagtggtcaggcgtgcaattttggtctgcgccacataaccattctgaagcttttaggcgttggagaggaagttgggggagtgttagaactgttcccaattaatgggagctctgttgttgagcgagaagacgtaccagcccatttggtgaaagacattcgtaactattttcaagtgagcccggagtacttctccatgcttctagtcggaaaagacggaaatgtcaaatcctggtatccttccccaatgtggtccatggtgattgtgtacgatttaattgattcgatgcaacttcggagacaggaaatggcgattcagcagtcactggggatgcgctgcccagaagatgagtatgcaggctatggttaccatagttaccaccaaggataccaggatggttaccaggatgactaccgtcatcatgagagttatcaccatggatacccttactgagcagaaatatgtaaccttagactcagccagtttcctctgcagctgctaaaactacatgtggccagctccattcttccacactgcgtactacatttcctgcctttttctttcagtgtttttctaagactaaataaatagcaaactttcacctattcatgagttattattgaaacctcaaatcataaagacatttaaaagaattgtttttctaactggaggggctctagtgctaaataatagtactgaaaattgatattattttccttttcttatatgaaggaccttatttggcatataaaattttataaaatatgtatttaaagctttttcttattttttgtattaattggtaagtgaaaactctgttaaagatcacaccacaatgttttcaagaaacatctgaaaagataaaacaaagaacaaataacttataatacttacttaaattgacactttttgaaatgccagtctgaaaataattaagatatctctgctttgtatgagtttcttttatgaaacttgataccacgggagtccagtaatattggccacaaaagccagagaaagtaccaagcccagctttgttatcatagccacttcctgccctgcttctgttatttttagtgttttttcagatataaatcggggtccaggaaatcctcaccagaatctggcactgcagccaaaggcgatacttccagagttctagtaggctgctatggaatttctggcatgaaaattcttgacccctcacactttaccccctgtacagcacaggcataccatggagatattacaggatcagttccagaccaccataataaagtggatatcgcaataaagtgagtcacacaaaatttttggtttctcagtgcatataaaagttatgtttacactctttagtagtctattaagtgtataatagctttatgtccaaaaaatgtacatgttttattttaaaaatactttattgctaaaaattgctaatgatcataatctttttgcattgatgttgatggctgctgaatgatcagggtggtggttactgaaggttgggggtgatggtggcaatttcttaaaataagacagcaatgaagtttgccacttcgattgactttttcttcatgaaagatttctctgcagcatgtgatgctgtatgatagcattttaccagtagtacaacttcttttgaaattggagccaatcctctcaaaccctgttgctgctttattaatgaaatttatgtaatgttgtaaatcctttgttgtcatttcaataatgtacatagcaacttacgcgagtagattccatctcaagaaatcactttcttcgttcattcataagaagcaagtcttcatctattaaacttttgtaatgagattgcagcaattcagtcacatcttcaggctccacttctaattccagttctcttgctatttccactatgtctatagcagagcttcctccaatgaagtcttgggcctcttaaaatcatccatgagggatggaatcagtttccgaactcattgatcttcctattttgaccttctcccatgaatcacgatgttcttaacagcatctagaatggtgaatcctttccaggtttttaatttgctttgcccagatccattagcgggatcacaatctgtgacagttatagtcttacgaaaagtgcaaatgactccttgattcctgtgctgcacaataggtattgtgttagcaggcacgaaaatattaatctccttgtatatctctatccaagttcttgggtgactgggtatattgtcagtgaacagctatatatatatatattatagtggtctggaactgatcatttatatatatattttatatacatatataaaatatataatatatattatatatatatatatttttttcgagatggagtctcgctctgtcacccaggctggagtgcagtggtgcgatcttggctcactgcaacctctgcctccggggttcaagtgattctcctgcctcagacccctgagtagctggatttacaggcgcccaccactacacccagcttatttttgtatttttagtagagatggggtttcaccatgttagtcagggtggtctcgaactactgactttggcctcggcctcccaaagtgctgggattacaggcatgagccactgcgcccggcccgaacagcaatatttttaaaagattctttttttttctgagcagtaagactcaaaaagtgagcttaaaatgtccagtaaaccatgctgtccatagacatgctgtcattcaggctttgttgctccatttatagagcacaggcagattagatttagcataattctgaaaagtcgtaggatttggggaaatggtaaatgagcattgatttcaacttaaaatcaccagctgcgttaacttctaacaaggagtaagcctgttggttgaagctttgaagtgaggcattgactactcctctctagatacgtaagtctgagatggcatcttcttccaatataaggctgtttcatctcttttgaaaatctattgtttagtgtagccactttcattaattatcttaactagatcttctggataacttactgcagcttctacatcaacatttgctgctttactttgcacttttatggatgcacaaggcttcttttcttcaaactcatgaaccagactctgctaccttcaaactttttttctgaagcttcctcacctccctttagctttcatagaattgaagagagttagggccttgctctgaactaggctttggcttaagggaattttgtggctggcttgatcttctattcagatgactcaaagtttctccatatcagcagtaaggctgttttacttttttatcattcatgcattcacaaagtagcacttttaatttccttcaagaacttttcctttgcatttacaacttggttgtttggcataagaggcttagctttcagcctgtctcagcttttgacacaccttcctcactaagcttattcatttctagcttttgatttaaagtgaaagattgcaacttcctctcacttgaaatacctggaggctattttagggttattaattgatctactttcaatattgtgtctcagggactaaggaggcctgagaagaaggagaaagattggagaaaggttggttgttggagcaatcagaacatacacacatttattaagtttactgtgttatataagtgtggttcatggtgcccccagtaattataatagcaacatcaaagatcgttgactacagattttaataacagagataataatgaaacagtgtgaaatatggcaagaattaccaaaatgtgacacagagacataaagtgagtacatactattgcaaaaatgatgtcaacagacttccttgatgcagggttgccacaaaccttcaatttgtaaaaaatgcagtatctgagaagtataataaaataagatgtgcctgtacttacttgctaatggacctattaccatactggcatcttataaaaaaaattacaaggaaggagattatatccagggattctttttgttttcaaggcaaaggttaccaagttacaatggaccaaagtagctggaatgcaaaggagtataatccttgtctttgaaaaaagagcatttgtttcaatcatatggcatatcaaagtaaactttctcccttcctccctcctttcgttgctgctgcttcttttttttctctttttttttttctttttttggagagggtctcactctgtcacccaggctgcagtgcagtagtgcaatcttggctcactgcaaactcagcttccctcaaacaatcctcccacctcagcatcccaagttagctgggaccacagccatgctccaccatgcccagccatccttgcttctttactacatttcttttttcaacaaatatttatcaagtaatattgtcaagtaatatttatgagcttcccctcagataggcatttagcatcatgatggcaccatcctctaacaataatgggaaggctattttccactgttattaatcattaattctccaaatcattttagtattattattaattctaataagtacagagattaataaatgcattcaaaccacatgtgaatatttgctataggtttatctgtgcctactgtatgttcagatttttctttatatctgaactttgttataaataaatgacagtaaaaatggaatttatagttcaatgaacttgacaaatcacttattctgccattcattttccataaagaccattcattcttccttgttttacaggtaactgagctccagaaagctcaagtgactttagaactcagttcttagtgtgtgaattatgctcccatctcatccctcttccttgatggagcactttcctcctcattttttcttggatagtctgtacaagctgcctgaggtgtgcaggaaagtgagccacgtcgaagtgtactgcttttaaatttttgccaggatgaagcatagcccaaagttgccaataaaaatggatttctttacctttctgaaattgtgtgatgacaatttctaagtaaaggacccaaatcatgtcaacttcaggaaatataataatgagggagccaggagcagtgaggggctcacacctgtaatcccagcactttgggaggccaaggtgagcgggtcgcttgagcccaggacttcgagaccagcctgggcaacacggcaaaaccctgtctctacaaaaaaatacaaaaaattagctgggtaaggtggtgtgtgtctgtggtcccagctattcaggaggctgaagtgagagaatcgcttgagcctaggaggtcgaggcttcagtgtgccgtgatcgtgccacagcactccatcatcatcatcctgggtgacaaagtgagaccctgtctccccaccaaaaaaaagagggagtttcatctcccaagaaaatgaattagataggaataatagaaaatttactctcagaataatagggttctagctcctgcaaccaaaaaaagatagttcttttttacaacctgagattactttttcaagcatttctccagttccactggcattgaaataatagttagcaatgcatctgagcttttcttcctctaatgagcaggcagagaagtcatagatcatcatttggaggactataaaataagacatagcttagcaaaaggaccaaaatacattcagaggaggatgctattggtgaatgtcctcaaagcctataatctggaaaaatacaaggcatatctctgaaactgtgaggattagcaaactagctaacctgaatctctgtcttctggtagtataaactaggtagtttcaaatctgagtagtttctccataaaagcatttcttcccaaacgtttcttaccaaactcccaaataaatgagaaaaataaaatacagttttataatttttgagaaagattatgggattatggtatttaaaaagaaaagcattctgtagagttggggaaatctggaagactcttgaggacatagctttgccgaaattgctggttgtcacaagactcttcaaaaactacttttcatcagacatctcccagggctctgaggtgaatattaattcagcagaaagatccttttctgctacataggcaggaggtccagacacaggggagtgggtgcaacccagctggtcccattttctgtaatataattaacaatgaagctcatactttctcaacttctagaagcctggaggatggaagcagcccgagagtagggtgaatgatggcctcagtgggcccttcttaatgtgtctcagtactgaatgtgtggagattgtagaaaaatagaaggcccttggaaaaaacctctgttcgtttctctgttcgtttcgctccctgatctccctgccggattgcttttctttcctttctcttccttggctgtcctttacctcatggtgtggggtgtgcagatagcaggttgtggcttggtgagtgctcttcacttcaggtcaaggtgaggcacagttaacatgctaactactttcctcagttctctctgagttgtgtaaagctcccgatgccagacttcctcttaattttgcacattattaaagtccaaagagttaagatttggtgatgaggggcaaagggccagctgtcacagaaatcaatgaaatgatacacagaaatgggtatcatgaaaaggccactggacttgggaaaactgggtgcctgtccttgccctgccatgtacttacctgtgtgactggaggtgagatgttttacctatgggcctcagtttctcattacaaaatgacagagaagactagatacctaagttcctaagtttgtgacatttgtgaatttttcttggccctctgtgagtagagtgctaaatttagaggcttcctgtggttgaactgatgtccaattctcagggaacccagacttctcagttcagaacccagttccagatttttgtgggaatagggaaaggtattaaataactccattgaattctttcctgcataatgccctgctgtggctgagactcaatgaggtcatcacctccaacacacagaacccctcatcatctccttacagccagactggagcttccaaggacatcaggttggcaaggattgtgagtaccctaaacatctaaagaggccctctaataagggacatatttgttcttcaacagtttcctaacttgagaccacaaatgcgtaatctctctaatatcctaaagcttggacaaactgggcagcccctgagcagaccgcacagagcttaaatgtcagtgctttccttccagaaagaaaaagaatggtcctacacctcccaatccatgggctgatacatatgccaagggagccggatgaagaagtgggtgattttaaatagctaagactgcccatgggcaaacgttctttggcttttctcctctgcaataagtataccttcctctctcctggtccttttctcctttcccaggcccctctatcaataataattctggctctcagatgactacagttgattaggtggaactgataggataaaggtgacacccttcccaaggctatctataatgcaaaaagatatccaagaaaaagagaggtagggaacaccttgggaaaccatttctggaagacagccagtccctgctgtagacaagcctcattttccttcccccaaatgttaaagagtaaattcctcctgtagccttagctctcttttctatctttggcttgctttttatgaactatctttagagtgccaaattagaacagggtaggcagaggcaggaatatgcccaaatttgggaagacctggttgggaatagtcgaaagccttgatatgtgcaaagaaagaaccatttgatcaacccagttcttaatacaggatactaacttaaaatttagactcaagttatacgataattcaaacatttattgtatttatactattctatatgtacttttccaggaaccaggaatacaaaactgacatttctctgtacagaggctcagactagtagagaacagttaggtacgccgttaattataaactaatatgtatcatcaattatgggtttttatgggggtttggcaggtggaagggaccagggagagatgatgagtgatgatggttatgtagtctttaggaggatgcaattataacattgctcttcctttcacgcaccacatgatttagcaagtacttcatattggctccaccattaacatggtcaatggcttctggatactcacagttcaggcacagtttctcctgaagattttttacctctcccatctttaagaaattgtctggatgtccatgaaagatgctgacacttgtattaattcattaaaaaacaccaccccctccctgaaataaactaaaaagtaatgaattcatagaaaaaaatttcaccaagattgaaactagagaatatacctagacttgcactttgagctttgagaaatgtgtacctattcaccattccaacgtgaagaagctctgcagtaggaaaaataattaacacacttatagtctactgcccatgtaaggatcagctccggctaagaggccaaagatgggtgacatcgttatgctctgcctttattttttctttcttacccacttagcttcctaattggaggaaggaggcgtggtaaaggtatatgaagactatggtttaattagaccagaaaacactgtcataatctctggggtcatcagaatgtccagttttgtctttgggccaagataagggcagtgggatttatgatgtgttgtttatagtctgaaactactctggtgatcaccagggtcagtttctttaatgatggtttccaactggcctaatacattaagtaagactggctgataacatgaccagacagacataaagaccctgttgggaatgacattgaactctcaaagtcaagatttcttacacaaatctatcagctggagaaaatgaaggcagtgtggtatatgtgtgcaaataaggacattatgaagcttaaatatggaatgtctcttggacccccgatgtcatctgtattctctttttcttcttgtactatatcctttgcctgtaaataaaaggtttatttga

SEQ ID NO: 348 - DNA, 3156 bp, Homo sapiens
ccctgctgcttactcggcgcccgcgcctcgggccgtcgggagcggagcctcctcgggaccaggacttcagggccacaggtgctgccaagatgctccagggcacctgctccgtgctcctgctctggggaatcctgggggccatccaggcccagcagcaggaggtcatctcgccggacactaccgagagaaacaacaactgcccagagaagaccgactgccccatccacgtgtacttcgtgctggacacctcggagagcgtcaccatgcagtcccccacggacatcctgctcttccacatgaagcagttcgtgccgcagttcatcagccagctgcagaacgagttctacctggaccaggtggcgctgagctggcgctacggcggcctgcacttctctgaccaggtggaggtgttcagcccaccgggcagcgaccgggcctccttcatcaagaacctgcagggcatcagctccttccgccgcggcaccttcaccgactgcgcgctggccaacatgacggagcagatccggcaggaccgcagcaagggcaccgtccacttcgccgtggtcatcaccgacggccacgtcaccggcagcccctgcgggggcatcaagctgcaggccgagcgggcccgcgaggagggcatccggctcttcgccgtggcccccaaccagaacctgaaggagcagggcctgcgggacatcgccagcacgccgcacgagctctaccgcaacgactacgccaccatgctgcccgactccaccgagatcgaccaggacaccatcaaccgcatcatcaaggtcatgaaacacgaagcctacggagagtgctacaaggtgagctgcctggaaatccctgggccctctggccccaagggctaccgtggacagaagggtgccaagggcaacatgggtgagccgggagagcctggccagaagggaagacagggagacccgggcatcgaaggccccattggattcccaggacccaagggcgttcctggcttcaaaggagagaagggtgaatttggagccgacggtcgcaagggggcccctggcctggctggcaagaacgggaccgatggacagaagggcaagctggggcgcatcggacctcctggctgcaagggagaccctggaaaccggggccccgacggttacccgggggaagcagggagtccaggggagcgaggagaccaaggcggcaagggggaccctggccgcccaggacgcagagggcccccgggagaaatcggggccaagggaagcaaggggtatcaaggcaacagtggagccccaggaagtcctggtgtgaaaggagccaagggcgggcctgggccccgcggacccaaaggcgagccggggcgcaggggagaccccggcaccaagggcagcccaggcagcgatggccccaagggggagaagggggaccctggccctgaggggccccgcggcctggctggagaggttggcaacaaaggagccaagggagaccgaggcttgcctggacccagaggcccccagggagctcttggggagcccggaaagcagggatctcggggagaccccggtgatgcaggaccccgtggagactcaggacagccaggccccaagggagaccccggcaggcctggattcagctacccaggaccccgaggagcacccggagaaaaaggcgagcccggcccacgcggccccgagggaggccgaggcgactttggcttgaaaggagaacctgggaggaaaggagagaaaggagagcctgcggatcctggtccccctggtgagccaggccctcgggggccaagaggagtcccaggacccgagggtgagcccggcccccctggagaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaacgtggtcaacaggctgggtgccatcgctaaggaccccaagtccgagacagggacgcgtgtgggcgtggtgcagtacagccacgagggcacctttgaggccatccagctggacgacgaacgtatcgactccctgtcgagcttcaaggaggctgtcaagaacctcgagtggattgcgggcggcacctggacaccctcagccctcaagtttgcctacgaccgcctcatcaaggagagccggcgccagaagacacgtgtgtttgcggtggtcatcacggacgggcgccacgaccctcgggacgatgacctcaacttgcgggcgctgtgcgaccgcgacgtcacagtgacggccatcggcatcggggacatgttccacgagaagcacgagagtgaaaacctctactccatcgcctgcgacaagccacagcaggtgcgcaacatgacgctgttctccgacctggtcgctgagaagttcatcgatgacatggaggacgtcctctgcccggaccctcagatcgtgtgcccagaccttccctgccaaacagatgcaccgtggcctggcggcgagcccccggtcaccttcctccgcacggaagaggggccggacgccaccttccccaggaccattcccctgatccaacagttgctaaacgccacggagctcacgcaggacccggccgcctactcccagctggtggccgtgctggtctacaccgccgagcgggccaagttcgccaccggggtagagcggcaggactggatggagctgttcattgacacctttaagctggtgcacagggacatcgtgggggaccccgagaccgcgctggccctctgctaaagcccgggcacccgcccagccgggctgggccctccctgccacactagcttcccagggctgcccccgacaggctggctctcagtggaggccagagatctggaatcggggtcagcggggctacagtccttccaggggctctggggcagctcccagcctcttcccatgctggtggccaccgtgtcccttgctgcggctgcatcttccagtctctcctccgtcttcctgtggccgctctctttataagaaccctggtcattgaatttaaggcccaccccaagtccagaatgacctcgcaagacccttaactcac

SEQ ID NO: 349 - DNA, 3544 bp, Homo sapiens
acacgcgcagccagccggccgcctcccgcgcccaagcgcgccgctctgctgtgccctgcgcccttgccccgcgccagcttctgcgcccgcagcccgcccggcgcccccggtgaccgtgaccctgccctgggcgcggggcggagcaggcatgtcccgcccggggaccgctaccccagcgctggccctggtgctcctggcagtgaccctggccggggtcggagcccagggcgcagccctcgaggaccctgattattacgggcaggagatctggagccgggagccctactacgcgcgcccggagcccgagctcgagaccttctctccgccgctgcctgcggggcccggggaggagtgggagcggcgcccgcaggagcccaggccgcccaagagggccaccaagcccaagaaagctcccaagagggagaagtcggctccggagccgcctccaccaggtaaacacagcaacaaaaaagttatgagaaccaagagctctgagaaggctgccaacgatgatcacagtgtccgtgtggcccgtgaagatgtcagagagagttgcccacctcttggtctggaaaccttaaaaatcacagacttccagctccatgcctccacggtgaagcgctatggcctgggggcacatcgagggagactcaacatccaggcgggcattaatgaaaatgatttttatgacggagcgtggtgcgcgggaagaaatgacctccagcagtggattgaagtggatgctcggcgcctgaccagattcactggtgtcatcactcaagggaggaactccctctggctgagtgactgggtgacatcctataaggtcatggtgagcaatgacagccacacgtgggtcactgttaagaatggatctggagacatgatatttgagggaaacagtgagaaggagatccctgttctcaatgagctacccgtccccatggtggcccgctacatccgcataaaccctcagtcctggtttgataatgggagcatctgcatgagaatggagatcctgggctgcccactgccagatcctaataattattatcaccgccggaacgagatgaccaccactgatgacctggattttaagcaccacaattataaggaaatgcgccagttgatgaaagttgtgaatgaaatgtgtcccaatatcaccagaatttacaacattggaaaaagccaccagggcctgaagctgtatgctgtggagatctcagatcaccctggggagcatgaagtcggtgagcccgagttccactacatcgcgggggcccacggcaatgaggtgctgggccgggagctgctgctgctgctggtgcagttcgtgtgtcaggagtacttggcccggaatgcgcgcatcgtccacctggtggaggagacgcggattcacgtcctcccctccctcaaccccgatggctacgagaaggcctacgaagggggctcggagctgggaggctggtccctgggacgctggacccacgatggaattgacatcaacaacaactttcctgatttaaacacgctgctctgggaggcagaggatcgacagaatgtccccaggaaagttcccaatcactatattgcaatccctgagtggtttctgtcggaaaatgccacggtggctgccgagaccagagcagtcatagcctggatggaaaaaatcccttttgtgctgggcggcaacctgcagggcggcgagctggtggtggcgtacccctacgacctggtgcggtccccctggaagacgcaggaacacacccccacccccgacgaccacgtgttccgctggctggcctactcctatgcctccacacaccgcctcatgacagacgcccggaggagggtgtgccacacggaggacttccagaaggaggagggcactgtcaatggggcctcctggcacaccgtcgctggaagtctgaacgatttcagctaccttcatacaaactgcttcgaactgtccatctacgtgggctgtgataaatacccacatgagagccagctgcccgaggagtgggagaataaccgggaatctctgatcgtgttcatggagcaggttcatcgtggcattaaaggcttggtgagagattcacatggaaaaggaatcccaaacgccattatctccgtagaaggcattaaccatgacatccgaacagccaacgatggggattactggcgcctcctgaaccctggagagtatgtggtcacagcaaaggccgaaggtttcactgcatccaccaagaactgtatggttggctatgacatgggggccacaaggtgtgacttcacacttagcaaaaccaacatggccaggatccgagagatcatggagaagtttgggaagcagcccgtcagcctgccagccaggcggctgaagctgcgggggcagaagagacgacagcgtgggtgaccctcctgggcccttgagactcgtctgggacccatgcaaattaaaccaacctggtagtagctccatagtggactcactcactgttgtttcctctgtaattcaagaagtgcctggaagagagggtgcattgtgaggcaggtcccaaaagggaaggctggaggctgaggctgttttcttttctttgttcccatttatccaaataacttggacagagcagcagagaaaagctgatgggagtgagagaactcagcaagccaacctgggaatcagagagagaaggagaaggaggggagcctgtccgttcagagcctctggctgcatagaaaaggattctggtgcttcccctgtttgcgtggcagcaagggttccacgtgcatttgcaatttgcacagctaaaattgcagcatttccccagctgggctgtcccaaatgttaccatttgagatgctcccaggcgtcctaagagaatccaccctctctggccctgggacattgcaagctgctacaaataaattctgtgttcttttgacaatagcgtcattgccaagtgcacatcagtgagcctcttgaatctgtttagtctcctttttcaacaaaggagtgtgttcagaaaaggagagagaggctgagatcattcaggagtttgttgggcagcaagcatggagcttcttgcacaaattctgggtccataaacaacccccaaagtccctgctgatccagtagccctggaggttccccaggtagggagagccagaggtgccagccttcctgaagggccagaaaatttagcctggatctcctcttttacctgctaggactggaaagagccagaagtggggtggcctgaagccctctctctgcttgaggtattgcccctgtgtggaattgagtgctcatgggttggcctcatatcagcctgggagttatttttgatatgtagaatgccagatcttccagattaggctaaatgtaatgaaaacctcttaggattatctgtggagcatcagtttgggaagaattattgaattatcttgcaagaaaaaagtatgtctcactttttgttaatgttgctgcctcattgacctgggaaaaatgaaaaaaaaaaataaagcaaatggtaagacc

SEQ ID NO: 350 - DNA, 1240 bp, Homo sapiens
gaaaggcgcattgatgcagcctgcggcggcctcggagcgcggcggagccagacgctgaccacgttcctctcctcggtctcctccgcctccagctccgcgctgcccggcagccgggagccatgcgaccccagggccccgccgcctccccgcagcggctccgcggcctcctgctgctcctgctgctgcagctgcccgcgccgtcgagcgcctctgagatccccaaggggaagcaaaaggcgcagctccggcagagggaggtggtggacctgtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggtacttgttcagattacccaaaaggagatgcttctactggatggaattcagtttctcgcatcattattgaagaactaccaaaataaatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaa

SEQ ID NO: 351 - DNA, 5579 bp, Homo sapiens
ataacagaccatctgtagactccttcggaaagcagcagagacgctgcagagggcttttcttagacatcaactgcagacggctggcaggatagaagcagcggctcacttggactttttcaccagggaaatcagagacaatgatggggctcttccccagaactacaggggctctggccatcttcgtggtggtcatattggttcatggagaattgcgaatagagactaaaggtcaatatgatgaagaagagatgactatgcaacaagctaaaagaaggcaaaaacgtgaatgggtgaaatttgccaaaccctgcagagaaggagaagataactcaaaaagaaacccaattgccaagattacttcagattaccaagcaacccagaaaatcacctaccgaatctctggagtgggaatcgatcagccgccttttggaatctttgttgttgacaaaaacactggagatattaacataacagctatagtcgaccgggaggaaactccaagcttcctgatcacatgtcgggctctaaatgcccaaggactagatgtagagaaaccacttatactaacggttaaaattttggatattaatgataatcctccagtattttcacaacaaattttcatgggtgaaattgaagaaaatagtgcctcaaactcactggtgatgatactaaatgccacagatgcagatgaaccaaaccacttgaattctaaaattgccttcaaaattgtctctcaggaaccagcaggcacacccatgttcctcctaagcagaaacactggggaagtccgtactttgaccaattctcttgaccgagagcaagctagcagctatcgtctggttgtgagtggtgcagacaaagatggagaaggactatcaactcaatgtgaatgtaatattaaagtgaaagatgtcaacgataacttcccaatgtttagagactctcagtattcagcacgtattgaagaaaatattttaagttctgaattacttcgatttcaagtaacagatttggatgaagagtacacagataattggcttgcagtatatttctttacctctgggaatgaaggaaattggtttgaaatacaaactgatcctagaactaatgaaggcatcctgaaagtggtgaaggctctagattatgaacaactacaaagcgtgaaacttagtattgctgtcaaaaacaaagctgaatttcaccaatcagttatctctcgataccgagttcagtcaaccccagtcacaattcaggtaataaatgtaagagaaggaattgcattccgtcctgcttccaagacatttactgtgcaaaaaggcataagtagcaaaaaattggtggattatatcctgggaacatatcaagccatcgatgaggacactaacaaagctgcctcaaatgtcaaatatgtcatgggacgtaacgatggtggatacctaatgattgattcaaaaactgctgaaatcaaatttgtcaaaaatatgaaccgagattctactttcatagttaacaaaacaatcacagctgaggttctggccatagatgaatacacgggtaaaacttctacaggcacggtatatgttagagtacccgatttcaatgacaattgtccaacagctgtcctcgaaaaagatgcagtttgcagttcttcaccttccgtggttgtctccgctagaacactgaataatagatacactggcccctatacatttgcactggaagatcaacctgtaaagttgcctgccgtatggagtatcacaaccctcaatgctacctcggccctcctcagagcccaggaacagatacctcctggagtataccacatctccctggtacttacagacagtcagaacaatcggtgtgagatgccacgcagcttgacactggaagtctgtcagtgtgacaacaggggcatctgtggaacttcttacccaaccacaagccctgggaccaggtatggcaggccgcactcagggaggctggggcctgccgccatcggcctgctgctccttggtctcctgctgctgctgttggccccccttctgctgttgacctgtgactgtggggcaggttctactgggggagtgacaggtggttttatcccagttcctgatggctcagaaggaacaattcatcagtggggaattgaaggagcccatcctgaagacaaggaaatcacaaatatttgtgtgcctcctgtaacagccaatggagccgatttcatggaaagttctgaagtttgtacaaatacgtatgccagaggcacagcggtggaaggcacttcaggaatggaaatgaccactaagcttggagcagccactgaatctggaggtgctgcaggctttgcaacagggacagtgtcaggagctgcttcaggattcggagcagccactggagttggcatctgttcctcagggcagtctggaaccatgagaacaaggcattccactggaggaaccaataaggactacgctgatggggcgataagcatgaattttctggactcctacttttctcagaaagcatttgcctgtgcggaggaagacgatggccaggaagcaaatgactgcttgttgatctatgataatgaaggcgcagatgccactggttctcctgtgggctccgtgggttgttgcagttttattgctgatgacctggatgacagcttcttggactcacttggacccaaatttaaaaaacttgcagagataagccttggtgttgatggtgaaggcaaagaagttcagccaccctctaaagacagcggttatgggattgaatcctgtggccatcccatagaagtccagcagacaggatttgttaagtgccagactttgtcaggaagtcaaggagcttctgctttgtccacctctgggtctgtccagccagctgtttccatccctgaccctctgcagcatggtaactatttagtaacggagacttactcggcttctggttccctcgtgcaaccttccactgcaggctttgatccacttctcacacaaaatgtgatagtgacagaaagggtgatctgtcccatttccagtgttcctggcaacctagctggcccaacgcagctacgagggtcacatactatgctctgtacagaggatccttgctcccgtctaatatgaccagaatgagctggaataccacactgaccaaatctggatctttggactaaagtattcaaaatagcatagcaaagctcactgtattgggctaataatttggcacttattagcttctctcataaactgatcacgattataaattaaatgtttgggttcataccccaaaagcaatatgttgtcactcctaattctcaagtactattcaaattgtagtaaatcttaaagtttttcaaaaccctaaaatcatattcgccaggaaattttcctaaacattcttaagcttctatttttcccctgccaaaggaaggtgtttatcattttaaaatgcaatgtgatttagtggattaagcaggagcgctggttcttgtctccattgccttttcttatatcattgataatgatgtaagaatcacaaggggccgggcgcggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcagtggcgggcgcctgtagtcccagctactcgggaggctgaggcaggagaatggcatgaacccgggaagcggagcttgcagtgagccgagattgcgccactgcagtccgcagtccggcctgggcgacagagcgagactccgtctcaaaaaaaaaaaaaaaaaaagaatcacaaggtatttgctaaagcattttgagctgcttggaaaaagggaagtagttgcagtagagtttcttccatcttcttggtgctgggaagccatatatgtgtcttttactcaagctaaggggtataagcttatgtgttgaatttgctacatctatatttcacatattctcacaataagagaattttgaaatagaaatatcatagaacatttaagaaagtttagtataaataatattttgtgtgttttaatccctttgaagggatctatccaaagaaaatattttacactgagctccttcctacacgtctcagtaacagatcctgtgttagtctttgaaaatagctcattttttaaatgtcagtgagtagatgtagcatacatatgatgtataatgacgtgtattatgttaacaatgtctgcagattttgtaggaatacaaaacatggccttttttataagcaaaacgggccaatgactagaataacacatagggcaatctgtgaatatgtattataagcagcattccagaaaagtagttggtgaaataattttcaagtcaaaaagggatatggaaagggaattatgagtaacctctattttttaagccttgcttttaaattaaacagctacagccatttaagccttgaggataataaagcttgagagtaataatgttaggttagcaaaggtttagatgtatcacttcatgcatgctaccatgatagtaatgcagctcttcgagtcatttctggtcattcaagatattcacccttttgcccatagaaagcaccctacctcacctgcttactgacattgtcttagctgatcacaagatcattatcagcctccattattccttactgtatataaaatacagagttttatattttcctttcttcgtttttcaccatattcaaaacctaaatttgtttttgcagatggaatgcaaagtaatcaagtgtttgtgctttcacctagaagggtgtggtcctgaaggaaagaggtcccctaaatatcccccaccctggtgctcctccctctccctggtaccctgactaccaggaagtcaggtgctagagcagctggagaagtgcaggcagcctgtgcttccacagatgggggtgctgctgcaacaaggctttcaatgtgcccatcttaggtgggagaagctagatcctgtgcagcagcctggtaagtcctgaggaggttccattgctcttcctgctgctgtcctttgcttctcaacggtggctcgctctacagtctagagcacatgcagctaacttgtgcctctgcttatgcatgagggttaaattaacaaccataaccttcatttgaagttcaaaggtgtattcaggatcctcaaagcattttaaccttgccgcttaaaacccaatttaccgtgaaatgggaattttgctgcattgttaaactgtagtggaaaccatgctatagtaataaaggttatataagagagaaattgaaattaaatgtgtttttaaatttcaaaaaaaaatcaatctttaggatgacttaaaaattgatttgccatgtaaaatgtatctgcattttttacacaaaacttgttttaagcataaaattttaaaactgtactacttgatgtattatacattttgaaccatatgtattaaaccataaacagtataatgttgttataataaaacaggcaataaatttataaataaaagctgaa

SEQ ID NO: 352 - DNA, 3890 bp, Homo sapiens
actctcgcgcctccgaacagccacaggggcaaagccctgtcacccccaggatccggtcatcagggaaagaggacagggagaccagaagagggccagctgggacgagggggcggacgcccaggaggcaacttctgagacgcagctcctgagaggggcagggaccaggcgcgggaggccagagggggcacagagaacaaaccccctcagaagtgaagaggagagcggaaggaaccgagaggggacggacaggagctgaggaggaaagaggaggggagaggggtcaggccaggcagccaaggagaagacgtgtggccgggggctatcagaaggaaactgggacggacgggccgggctcgggctgtcctgtggagcagcagcatccccggggccggcagaggcgccagtggctgggcgggatgagtctctgagggccactgtggagcgccccgccatggccccccgcaccctctggagctgctacctctgctgcctgctgacggcagctgcaggggccgccagctaccctcctcgaggtttcagcctctacacaggttccagtggggccctcagccccggggggccccaggcccagattgccccccggccagccagccgccacaggaactggtgtgcctacgtggtgacccggacagtgagctgtgtccttgaggatggagtggagacatatgtcaagtaccagccttgtgcctggggccagccccagtgtccccaaagcatcatgtaccgccgcttcctccgccctcgctaccgtgtggcctacaagacagtgaccgacatggagtggaggtgctgtcagggttatgggggcgatgactgtgctgagagtcccgctccagcgctggggcctgcgtcttccacaccacggcccctggcccggcctgcccgccccaacctctctggctccagtgcaggcagccccctcagtggactggggggagaaggtcctggggagtcagagaaggtgcagcagctggaggaacaggtgcagagcctgaccaaggagctgcaaggcctgcggggcgtcctgcaaggactgagcgggcgcctggcagaggatgtgcagagggctgtggagacggccttcaacgggaggcagcagccagctgacgcggctgcccgccctggggtgcatgaaaccctcaatgagatccagcaccagctgcagctcctggacacccgcgtctccacccacgaccaggagctgggtcacctcaacaaccatcatggcggcagcagcagcagtgggggcagcagggccccagccccagcctcagcccctccgggccccagtgaggagctgctgcggcagctggagcagcggttgcaggagtcctgctccgtgtgcctggccgggctagatggcttccgccggcagcagcaggaggacagggagcggctgcgagcgatggagaagctgctggcctcggtggaggagcggcaacggcacctcgcagggctggcggtgggccgcaggccccctcaggaatgctgctctccagagctgggccggcgactggcagagctggagcgcaggctggatgtcgtggccggctcagtgacagtgctgagtgggcggcgaggcacagagctgggaggagccgcggggcagggaggccaccccccaggctacaccagcttggcctcccgcctgtctcgcctggaggaccgcttcaactccaccctgggcccttcggaggagcaggaggagagctggcctggggctcctggggggctgagccactggctgcctgctgcccggggccgactagagcagttgggggggctgctggccaatgtgagcggggagctgggggggcggttggatctgttggaggagcaggtggcaggggccatgcaggcatgcgggcagctctgctctggggcccctggggagcaggactctcaagtcagcgagatcctcagtgccttggagcgcagggtgctggacagtgaggggcagctgcggctggtgggctccggcctgcacacggtggaagcagcgggggaggcccggcaggccacgctggagggattacaagaggttgtgggccggctccaggatcgtgtggatgcccaggatgagacagctgcagagttcacactacggctgaatctcactgcggcccggctaggccaactggaggggctgctgcaggcccatggggatgagggctgtggggcctgtggcggagtccaagaggaactaggccgccttcgggatggtgtggagcgctgctcctgccccctgttgcctcctcggggtcctggggctggtccaggtgttgggggcccaagccgtgggcccctggacggcttcagcgtgtttgggggcagctcaggctcagccctgcaggccctgcaaggagagctctctgaggttattctcagcttcagctccctcaatgactcactgaatgagctccagaccactgtggagggccagggcgctgatctggctgacctgggggcaaccaaggaccgtatcatttctgagattaacaggctgcagcaggaggccacagagcatgctacagagagtgaagagcgcttccgaggcctagaggagggacaagcacaggccggccagtgccccagcttagaggggcgattgggccgtcttgagggtgtctgtgaacggttggacactgtggctgggggactgcagggcctgcgcgagggcctttccagacacgtggctgggctctgggctgggctccgggaaaccaacaccaccagccagatgcaggcagccctgctggagaagctggtcgggggacaggcgggcctgggcaggcggctgggtgcccttaacagctccctgcagctcctggaggaccgtctgcaccagctcagcctgaaggacctcactgggcctgcaggagaggctgggcccccagggcctcctgggctgcagggacccccaggccctgctggacctccaggatcaccaggcaaggacgggcaagagggccccatcgggccaccaggtcctcaaggtgaacagggagtggagggggcaccagcagcccctgtgccccaagtggcattttcagctgctctgagtttgccccggtctgaaccaggcacggtccccttcgacagagtcctgctcaatgatggaggctattatgatccagagacaggcgtgttcacagcgccactggctggacgctacttgctgagcgcggtgctgactgggcaccggcacgagaaagtggaggccgtgctgtcccgctccaaccagggcgtggcccgcgtagactccggtggctacgagcctgagggcctggagaataagccggtggccgagagccagcccagcccgggcaccctgggcgtcttcagcctcatcctgccgctgcaggccggggacacggtctgcgtcgacctggtcatggggcagctggcgcactcggaggagccgctcaccatcttcagcggggccctgctctatggggacccagagcttgaacacgcgtagactggggtcccgcccgacgtgtctacgtcggctgaagagacagcgggggcggcgggctcctggggtctcgcctgagacggggcacctagccctgggcgagcgccgcacccgggcccgcagcggcaccgcgcccagagcggcctctccccacgcccggggcgcgccggctcagggaggctcggggccgcccatgcagacttttggcctggcgcgatcccccaagaacccctccagggccggcctgcggaggagccgatcctcgcaccctccgctccctccactggccctccaggtcgattccctgggctccaggctcccccgcgcgggcgccgcccaccgccatactaaacgatcgaggaataaagacacttggtttttctaaaaaaaa

SEQ ID NO: 353 - DNA, 3879 bp, Homo sapiens
ggagtgctgcctggcgctggctaggaggcaaacgcacgcgggaagagctgctacccattccagggaccctgccgctgcccctctgaggggtctgcacctcctgggagcaggtgggtctctgggacgagggtccatggtggatggctctggagacgctcccgaggctgtgccgtcccgctgctgcacaggtcggagggtcaccgcagaggctactcgggctggggctggggccgagggagcccgcactggagccccatgtggaacccaaggatgcagctgctctgctaacacggcagcccatccttcaagactgtgacctcgccacagtggccctcagccctccacctccggcgggggcgagggccacccacctccaagtctccagccatgacgacctccgcactccggcgccaggtgaagaacatcgtgcacaactactccgaggcagaaatcaaggtgcgcgaggccaccagcaatgacccctggggcccccctagttcgctcatgtccgagatcgctgacctgaccttcaacacagtggccttcaccgaagtcatgggcatgctgtggcggcggctcaatgacagcggcaagaactggcggcacgtgtacaaggctctaacattgctggactacctgctcaagacgggctccgagcgggtggcccaccagtgccgcgagaacctctacaccatccagacactcaaggacttccagtacatcgaccgcgacggcaaggaccagggcgtcaacgtgcgcgagaaggtcaagcaggtgatggccctgctcaaggatgaggagcggctgcggcaggagcgaacccacgccctcaagaccaaggagcgcatggcactggagggcatcggcattggcagtgggcagctgggcttcagccgccgctacggcgaggactacagccgctcccggggctccccgtcctcctacaactcctcctcttcgtcaccccgctatacctccgacctggagcaggcccggcctcagacgtcaggggaagaggaactgcagctgcagctggccctcgccatgagccgtgaggaggcagagaagcctgtccccccagcctcccacagggacgaggacctgcagctgcagctggctctgcgcctgagccggcaggagcacgagaaggaggtgaggtcctggcagggtgatggctcccccatggccaatggtgcaggggccgtggtccaccatcagcgggacagagagcctgagagagaagagagaaaggaggaggagaagctaaaaaccagccagtcctccatcctggacttggctgacatcttcgtacctgccctggccccgccctccacacactgctctgctgacccatgggacatcccaggttttaggccgaacacagaggccagtggatcctcctgggggccttctgcagacccctggtctccgatcccctcaggaaccgtcctgtcccgaagccagccctgggatctgactcccatgctctcctcctctgagccctggggcaggaccccagtgctgcctgctgggccccccaccacagacccctgggccctgaactctccccaccacaaactccccagcactggggctgacccttggggagcctccctggagacctccgacacacctggtggtgcctcgacctttgacccatttgccaaacctccagaatccacagagaccaaggaggggctggagcaggccctgccctctgggaagcccagcagccctgtggagctggacctgtttggagaccccagccccagttccaagcaaaatggcacgaaggagccagatgccctggacctgggcatactaggggaagcactaacccagccaagcaaagaggcccgagcttgccggactcccgagtccttcctgggtccctcagcttcctccttggtcaaccttgactcgttggtcaaggcaccccaggttgcaaagacccggaaccccttcctgacaggtctcagcgctccgtcccccaccaacccgttcggcgcgggcgagccgggcaggccgacgctaaaccagatgcgcaccggctcgccggcgctgggcctggcaggcgggcctgtgggggcgcccctgggctccatgacctacagcgcctctctgcccctcccgctcagcagcgtgccagctggcttgaccctccccgcctcggttagcgtcttcccgcaggccggagccttcgcaccgcagccgctgctgcccacgccgagctcagccgggccgcggcccccgcccccgcagaccggcaccaaccccttcctctgagccccgccccgtcccataccggcctgcgcctgcgccggacgctccgcggccccgcctccggacccggggctgggcggggcgccggtgctagtggaacgccgagccagtggcggctggtatcccgcggcggctctggaagctggacgcggaccacggcccgggagctagaaactgaacgcccgcataataaagactggaaccctcgttctcagctctcaccaagtggactttttgcggggtgtggcggccgggtctcgaccacagcgtggatcaccggctgtttaggaaactgcagctgcacaacgtggggtgcaaaactgccccgcttcctttacagctcttctcaaccctcacctccatcccccgtcacccaggcaccttcgcttccagatgctgccaggctgtcactcaattcggtcatttcattcatttatcacacatgggcactggggttgggctaacagcaagagacaataggcctttgttcctatttattgggtactgcttacgtgctaagcagatcagtttatttaatgcttgcaacgactctctgaggtagaaaatattgttaattccgttcaggatcccggctacataatctgtggggctcaatacaaaataaaaatgtaggggctccttgttcaaaatcgtatgaagaatttcaaaacagggacaacagagcatgaaaccaagcgcaaagcccactgcagtgcgattgcacaggtatctcaccttgcagccggcactactcccatttttcaggcaaggaaaccgtggctcagagaggttgaatggcatgctcaaagtcacaaagctggcatggggcggggctggaactcaagagtcagacagtctggctccaaggcctggagatcccaggctgggccccagatttaattcagcaaatattgactgactgctgtggacaaagtgctgggctcaccttggagggatccaacctccaggagctcgagcgcagcagggtagacaagccaggggcacgtgatgcggctgtggcagaagccaagtgcaggagctcccaggctcctttgttttactgagtcaccttaaatgtaactctgccctctcccttgcttcgccaaggctagcgagaaactcagtcttagccacacaggaggaatcggaccccttctgggggtttatgtggagtctgggaaaccaagggtggggtgaggcctggtactcaatccaggaggggcccctatgaccaccctcgcctgtttttcttctcaatgctccctgatcactggaccactggacactgatgtgtcctcagtgcttggggtctggctctgcaggcagcctgcagccagcctccatccccctttcagggacaaatggccttccaccagagtcggtgagtggagaggcacaatgccactccccttcctgaggtgggggtaggggaagggagtcccacaatgcagttacaaacaggatggacaagaacacctgctcaggagtcagacttacagggttcaaagttctgctccaaggtttgaccctaacaagaatcacttagtaataagtggttatgctctgtgaccttgagtaaattacttaccctctcca

SEQ ID NO: 354 - DNA, 11609 bp, Homo sapiens
agagactgtgggtgccacaagcggacaggagccacagctgggacagctgcgagcggagccgagcagtggctgtagcggccacgactgggagcagccgccgccgcctcctcgggagtcggagccgccgcttctccactggcaggggccgcctgaagtgggagcagcgcctggagaaggcgggaggagcccggcccgggggacgggcggcgggatagcgggaccccggcggcgcggtgcgcttcagggcgcagcggcggccgcagaccgagccccgggcgcggcaagaggcggcgggagccggtggcggctcggcatcatgcgtcgagggcgtctgctggagatcgccctgggatttaccgtgcttttagcgtcctacacgagccatggggcggacgccaatttggaggctgggaacgtgaaggaaaccagagccagtcgggccaagagaagaggcggtggaggacacgacgcgcttaaaggacccaatgtctgtggatcacgttataatgcttactgttgccctggatggaaaaccttacctggcggaaatcagtgtattgtccccatttgccggcattcctgtggggatggattttgttcgaggccaaatatgtgcacttgcccatctggtcagatagctccttcctgtggctccagatccatacaacactgcaatattcgctgtatgaatggaggtagctgcagtgacgatcactgtctatgccagaaaggatacatagggactcactgtggacaacctgtttgtgaaagtggctgtctcaatggaggaaggtgtgtggccccaaatcgatgtgcatgcacttacggatttactggaccccagtgtgaaagagattacaggacaggcccatgttttactgtgatcagcaaccagatgtgccagggacaactcagcgggattgtctgcacaaaaacgctctgctgtgccacagtcggccgagcctggggccacccctgtgagatgtgtcctgcccagcctcacccctgccgccgtggcttcattccaaatatccgcacgggagcttgtcaagatgtggatgaatgccaggccatccccgggctctgtcagggaggaaattgcattaatactgttgggtcttttgagtgcaaatgccctgctggacacaaacttaatgaagtgtcacaaaaatgtgaagatattgatgaatgcagcaccattcctggaatctgtgaagggggtgaatgtacaaacacagtcagcagttacttttgcaaatgtccccctggtttttacacctctccagatggtaccagatgcatagatgttcgcccaggatactgttacacagctctgacaaacgggcgctgctctaaccagctgccacagtccataaccaaaatgcagtgctgctgtgatgccggccgatgctggtctccaggggtcactgtcgcccctgagatgtgtcccatcagagcaaccgaggatttcaacaagctgtgctctgttcctatggtaattcctgggagaccagaatatcctcccccaccccttggccccattcctccagttctccctgttcctcctggctttcctcctggacctcaaattccggtccctcgaccaccagtggaatatctgtatccatctcgggagccaccaagggtgctgccagtaaacgttactgattactgccagttggtccgctatctctgtcaaaatggacgctgcattccaactcctgggagttaccggtgtgagtgcaacaaagggttccagctggacctccgtggggagtgtattgatgttgatgaatgtgagaaaaacccctgtgctggtggtgagtgtattaacaaccagggttcgtacacctgtcagtgccgagctggatatcagagcacactcacgcggacagaatgccgagacattgatgagtgtttacagaatggccggatctgcaataatggacgctgcatcaacacagatggcagttttcattgcgtgtgtaatgcgggctttcatgttacacgagatgggaagaactgtgaagatatggatgaatgcagcataaggaacatgtgccttaatggaatgtgtatcaatgaagatggcagttttaaatgtatttgcaaacctggattccagctggcatcagatggacgttattgcaaagacattaacgagtgtgaaacccctgggatctgcatgaatgggcgttgcgtcaacactgatggctcctacagatgtgaatgcttccctggactggctgtgggtctggatggccgtgtgtgtgttgacacacacatgcggagcacatgctatggtggatacaagagaggccagtgtatcaaacctttgtttggtgctgtcactaaatctgaatgctgttgcgccagcactgagtatgcatttggggaaccttgccagccgtgtcctgcacagaattcagcggaatatcaggcactctgcagcagtgggccaggaatgacgtcagcaggcagtgatataaatgaatgtgcactagatcctgatatttgcccaaatggaatctgtgaaaaccttcgtgggacctataaatgtatatgcaattcaggatatgaagtggattcaactgggaaaaactgcgttgatattaatgaatgtgtactgaacagtctcctttgtgacaatggacaatgtagaaatactcctggaagttttgtctgtacctgccccaagggatttatctacaaacctgatctaaaaacatgtgaagacattgatgaatgcgaatcaagtccttgcattaatggagtctgcaagaacagcccaggctcttttatttgtgaatgttcttctgaaagtactttggatccaacaaaaaccatctgcatagaaaccatcaagggcacttgctggcagactgtcattgatgggcgatgtgagatcaacatcaatggagccaccttaaagtcccagtgctgctcctccctcggtgctgcgtggggaagcccgtgcaccctatgccaagttgatcccatatgtggtaaagggtactcaagaattaaaggaacacaatgtgaagatatagatgaatgtgaagtgttcccaggagtgtgtaaaaatggcctgtgtgttaacactagggggtcattcaagtgtcagtgtcccagtggaatgactttggatgccacaggaaggatctgtcttgatatccgcctggaaacctgcttcctgaggtacgaggacgaggagtgcaccctgcctattgctggccgccaccgcatggacgcctgctgctgctccgtcggggcagcctggggtactgaggaatgcgaggagtgtcccatgagaaatactcctgagtacgaggagctgtgtccgagaggacccggatttgccacaaaagaaattacaaatggaaagcctttcttcaaagatatcaatgagtgcaagatgatacccagcctctgcacccacggcaagtgcagaaacaccattggcagctttaagtgcaggtgtgacagcggctttgctcttgattctgaagaaaggaactgcacagacattgacgaatgccgcatatctcctgacctctgtggcagaggccagtgtgtgaacacccctggggactttgaatgcaagtgtgacgaaggctatgaaagtggattcatgatgatgaagaactgcatggatattgatgagtgtcagagagatcctctcctatgccgaggtggtgtttgccataacacagagggaagttaccgctgtgaatgcccgcctggccatcagctgtcccccaacatctccgcgtgtatcgacatcaatgaatgtgagctgagtgcacacctgtgccccaatggccgttgcgtgaacctcatagggaagtatcagtgtgcctgcaaccctggctaccattcaactcccgataggctattttgtgttgacattgatgaatgcagcataatgaatggtggttgtgaaaccttctgcacaaactctgaaggcagctatgaatgtagctgtcagccgggatttgcactaatgcctgaccagagatcatgcaccgacatcgatgagtgtgaagataatcccaatatctgtgatggtggtcagtgcacaaatatccctggagagtacaggtgcttgtgttatgatggattcatggcatctgaagacatgaagacttgtgtagatgtcaatgagtgtgacctgaatccaaatatctgcctaagtgggacctgtgaaaacacgaaaggctcatttatctgccactgtgatatgggctactccggcaaaaaaggaaaaactggctgtacagacatcaatgaatgtgaaattggagcacacaactgtggcaaacatgctgtatgtaccaatacagcaggaagcttcaaatgtagctgcagtcccgggtggattggagatggcattaagtgcactgatctggacgaatgttccaatggaacccatatgtgcagccagcatgcagactgcaagaataccatgggatcttaccgctgtctgtgcaaggaaggatacacaggtgatggcttcacttgtacagaccttgatgagtgctctgagaacctgaatctctgtggcaatggccagtgcctcaatgcaccaggaggataccgctgtgaatgcgacatgggcttcgtgcccagtgctgacgggaaagcctgtgaagatattgatgagtgctcccttccgaacatctgtgtctttggaacttgccacaacctccctggcctgttccgctgtgagtgtgagataggctacgaactggacagaagcggcgggaactgcacagatgtgaatgaatgcctggatccaaccacgtgcatcagtgggaactgtgtcaacactccaggcagctatatctgtgactgcccacctgattttgaactgaacccaactcgagttggctgtgttgatacccgctctggaaattgctatttggatattcgacctcgaggagacaatggagatacagcctgcagcaatgaaattggagttggtgtttccaaagcttcctgctgctgttctctgggtaaagcctggggtactccttgtgagatgtgtcctgctgtgaacacatccgagtacaaaattctttgtcctggaggggaaggtttccgaccaaatcctatcaccgttatattggaagatattgatgagtgccaggagctaccagggctgtgccaaggaggaaaatgtatcaacacctttgggagtttccagtgccgctgtccaaccggctactacctgaatgaagatacacgagtgtgtgatgatgtgaatgaatgtgagactcctggaatctgtggtccagggacatgttacaacaccgttggcaactacacctgtatctgtcctccagactacatgcaagtgaatgggggaaataattgcatggatatgagaagaagtttgtgctacagaaactactatgctgacaaccagacctgtgatggagaattgttattcaacatgaccaagaagatgtgctgctgttcctacaacattggccgggcgtggaacaagccctgtgaacagtgtcccatcccaagtacagatgagtttgctacactctgtggaagtcaaaggccaggctttgtcatcgacatttataccggtttacccgttgatattgatgagtgccgggagatcccaggggtctgtgaaaatggagtgtgtatcaacatggttggcagcttccgatgtgaatgtccagtgggattcttctataatgacaagttgttggtttgtgaagatattgacgagtgtcagaacggcccagtgtgccagcgcaacgccgaatgcatcaacactgcaggcagctaccgctgtgactgtaagcccggctaccgcttcacctccacaggacagtgcaatgatcgtaatgaatgtcaagaaatccccaatatatgcagtcatgggcagtgcattgacacagttggaagcttttattgcctttgccacactggttttaaaacaaatgatgaccaaaccatgtgcttggacataaatgaatgtgaaagagatgcctgtgggaatggaacttgccggaacacaattggttccttcaactgccgctgcaatcatggtttcatcctttctcacaacaatgactgtatagatgttgatgaatgtgcaagtggaaatgggaatctttgcagaaatggccaatgcattaatacagtggggtctttccagtgccagtgcaatgaaggctatgaggtggctccagatgggaggacctgtgtggatatcaatgaatgtcttctagaacccagaaaatgtgcaccaggtacctgtcaaaacttggatgggtcctacagatgcatttgcccacctggatacagtcttcaaaatgagaagtgtgaagatattgatgagtgtgtcgaagagccagaaatttgtgccctgggcacatgcagtaacactgaaggcagcttcaaatgtctgtgtccagaagggttttccttgtcctccagtggaagaaggtgccaagatttgcgaatgagctactgttatgcgaagtttgaaggaggaaagtgttcatcacccaaatccagaaatcactccaagcaggaatgctgctgtgccttgaagggagaaggctggggagacccctgcgagctctgccccacggaacctgatgaggccttccgccagatatgtccttatggaagtgggatcatcgtgggacctgatgattcagcagttgatatggacgaatgcaaagaacccgatgtctgtaaacatggacagtgcatcaatacagatggttcctatcgctgcgagtgtccctttggttatattctagcagggaatgaatgtgtagatactgatgaatgttctgttggcaatccttgtggaaatggaacctgcaagaatgtgattggaggttttgaatgcacctgcgaggagggatttgagcccggtccaatgatgacatgtgaagatataaatgaatgtgcccagaatcctctgctctgtgccttccgatgtgtgaacacttatgggtcatatgaatgcaaatgtcccgtgggatatgtgctcagagaagaccgtaggatgtgcaaagatgaggatgagtgtgaagagggaaaacatgactgtactgaaaaacaaatggaatgcaagaacctcattggcacatatatgtgcatctgtggacccgggtatcagcggagacctgatggagaaggctgtgtagatgagaatgaatgtcagacgaagccagggatctgtgagaatgggcgctgcctcaacacccgtgggagctacacctgtgagtgtaatgatgggtttaccgccagccccaaccaggacgagtgccttgacaatcgggaagggtactgcttcacagaggtgctacaaaacatgtgtcagatcggctccagcaacaggaaccccgtcaccaaatcggaatgctgctgtgacggagggagaggctggggtccccactgtgagatctgccctttccaggggactgtggctttcaagaaactctgtccccatggccgaggattcatgaccaatggagcagatatcgatgaatgcaaggttattcacgatgtttgccgaaatggggaatgtgtcaatgacagaggatcatatcattgcatttgtaaaactgggtacactccagatataactgggacttcctgtgtagatctgaacgagtgcaaccaggctcccaaaccctgcaattttatctgcaaaaacacagaagggagttaccagtgttcatgcccgaaaggctacattctgcaagaggatggaaggagctgcaaagatcttgatgagtgtgcaaccaagcaacacaactgccagttcctatgtgttaacaccattggcggcttcacatgcaaatgtcctcccggatttacccaacaccatacgtcctgcattgataacaatgaatgcacctctgacatcaatctgtgcgggtctaagggcatttgccagaacactcctggaagcttcacctgtgaatgccagcggggattctcacttgatcagaccggctccagctgtgaagacgtggacgagtgtgagggtaaccaccgctgccagcatggctgccagaacatcattgggggctacaggtgcagctgcccccagggctacctccagcactaccagtggaaccagtgtgttgatgaaaacgaatgcctcagcgctcacatctgcggaggagcctcctgtcacaacaccctggggagctacaagtgcatgtgtcccgccggcttccagtatgaacagttcagtggaggatgccaagacatcaatgaatgtggctctgcgcaggccccctgcagctatggctgttccaataccgagggcggttacctgtgtggctgtccacctggttacttccgcataggccaagggcactgtgtttctggaatgggcatgggccgaggaaacccagagccacctgtcagtggtgaaatggatgacaattcactctccccagaggcttgttacgagtgtaagatcaatggctaccccaaacggggcaggaaacggagaagcacaaacgaaactgatgcctccaatatcgaggatcagtctgagacagaagccaatgtgagtcttgcaagttgggatgttgagaagacagccatctttgctttcaatatttcccacgtcagtaacaaggttcgaatcctagaactccttccagctcttacaactctgacgaatcacaacagatacttgatcgaatctggaaatgaagatggcttctttaaaatcaaccaaaaggaagggatcagctacctccacttcacaaagaagaagccagtggctggaacctattcattacaaatcagtagtactccactttataaaaagaaagaacttaaccaactagaagacaaatatgacaaagactacctcagtggtgaactgggtgataatctgaagatgaaaatccaggttttgcttcattaattcaccatccagagaccaaataattaaaagaaaaacaaatatagataggtagaactatattttcccccaatcagaatcatcatatcataggtacaatctttcaccaagtaaatttgtataaataagcactattctttgtattaccaaagcaaggtacaggtgactaccctagttcaaaacaaccactttctcaggcttctcatgtgtgtagctaagctaccttgtcatatgtgttgattcttgaaaactgggacgtgtatttccattgggggttggccatttatgctgacatgccatccttccagcaaacgtacgggaatgtgctttcaattgatggactactctattttttgcaaatttgtaaactttgcttctccaaatacaagtactaggttgtccatttatggtacctatttggtgctagtaaattttcaaactagatttataaatgcactgtaatatgtacacaacttagaaaccaaattacaagtattcagttccaatacttcattaatttcaatcaaccaaagttagttcagtagcttatctcagttatgagtataatacattacatgtaaattaagtgtgtgtatactgtaatcgtgctattttttatcattgaaacatttataaactagaataataatgcccttaatgtgagggtttgtaatggtgcttattaagaccaaagacttgttaaatgtatacaccaagtggtaatgaaatttcggtgactggcccacacgtgcatagaggtctgggaggaccaggaaacagcctcagtggccagaggatcaccagtgcatccttcatcacagcatgtgcaatatgccaagattaccctcggtcattcctgtcaacaaggggtcaatgtcataaatgtcacaataaaacaatctcttcttttttttagtttaccccttggctttgtgttcttgcatggatttggggttggaggggccattccggaggctaaataaagtctcctggatttaaattatcctgggtctcttacttatggcttatgaaagtaccaaatgtataaccactagaagaaaatttaacatatgagtcgatcccttgttttatccattgaaagtagcagagtctggtgtcattaacctgacttgcttgtgagaaatttagattgtagagtcatttctgaaacatgacctaattcatcttgtgacttttaaatagtcttaaataccaagttcagtcattgtcttagagcacatgaatttcattataatagatttatcatgcccccctctcaaatatacacagttttggcaagccttaggtgttctgttccatttttttttcccctaaacatctttcgttagtcaatgctcatctaattacaaagggataatcccagactgtatccaattgctgtaacttttggtttcttaatgtcataatttttaaagtctgttttattttaagtgcaatattgagtatttagctgttaggctcaatccgtcgatatgaaataattttttaaatccctaagggcaggaaagcatttcgtggtagtgaaaataagaggaaataagatggcatgaaggtggtgggcggagaaactaggtaggacacaggaaagtgctctcaaaaatctttgaagagctcagctgaaaaaaatggagtagatttggctcatactattccggaaggcaaaaccagggtcagctgatgtcagccccagtttaatacacacggtcccaattatagagctactcactgaaagaatgggtttccttgcattgtggtgagctccctgtcacaagatagaagagtttcagtctaggcttaatggcaaccattggacaaagatgctttcttccacctaacaggccattaacatcttaaaggtatttttgtatctctaattttgtttataataggtgctcaacagaatgagctgaatggctgttacaaagggggtttgtaccttgggtaagagattaaaatataactcaaaatttccttctaacgctgcacctatggaaccatgtgatagaggtgtattaaaattgttatcgaagaatatatagcatatggtaaacaacagtttgcatatggaaaatgtctttgataatttaaccagaactgcattatattcaataacggattttctttataacaaacaacaggggaaaatggagttggcacacagtggatcactttgatatttttaatagtccaagtctggattttatttattcctgagccaacaattttgaacagcatattttccatgtttctgactgtaacaaaacattttcctcattgttccattgtaaatattcctcttgttggaactctttttaatcctgagatttaaacctgtacctttcaattgtctgtgacctttcaatttcactttcaatagttgaagaacttggctttgtaaatctctcagaagcttgaaaatatcttgtctctaccccctcagcccatttcatttgccaataattattttgtaagtagggttgaaatgaactcagctggccttgtgaaatgtttaaacttgcacaaacaactacatttttgttcaacaaatagcagtttactcagccaaaatcactttggatattgccattacaaatactgttaaacttcagaaatcatgtctgtaaattagatgagccaaaataaaggacaattgggttga

SEQ ID NO: 355 - DNA, 5321 bp, Homo sapiens
acacacacacacaagcacacacgcgctcacacacagagagaaaatccttctgcctgttgatttatggaaacaattatgattctgctggagaacttttcagctgagaaatagtttgtagctacagtagaaaggctcaagttgcaccaggcagacaacagacatggaattcttatatatccagctgttagcaacaaaacaaaagtcaaatagcaaacagcgtcacagcaactgaacttactacgaactgtttttatgaggatttatcaacagagttatttaaggaggaatcctgtgttgttatcaggaactaaaaggataaggctaacaatttggaaagagcaactactctttcttaaatcaatctacaattcacagataggaagaggtcaatgacctaggagtaacaatcaactcaagattcattttcattatgttattcatgaacacccggagcactacactataatgcacaaatggatactgacatggatcctgccaactttgctctacagatcatgctttcacattatctgtctagtgggtactatatctttagcttgcaatgacatgactccagagcaaatggctacaaatgtgaactgttccagccctgagcgacacacaagaagttatgattacatggaaggaggggatataagagtgagaagactcttctgtcgaacacagtggtacctgaggatcgataaaagaggcaaagtaaaagggacccaagagatgaagaataattacaatatcatggaaatcaggacagtggcagttggaattgtggcaatcaaaggggtggaaagtgaattctatcttgcaatgaacaaggaaggaaaactctatgcaaagaaagaatgcaatgaagattgtaacttcaaagaactaattctggaaaaccattacaacacatatgcatcagctaaatggacacacaacggaggggaaatgtttgttgccttaaatcaaaaggggattcctgtaagaggaaaaaaaacgaagaaagaacaaaaaacagcccactttcttcctatggcaataacttaattgcatatggtatataaagaaccagttccagcagggagatttctttaagtggactgttttctttcttctcaaaattttctttccttttattttttagtaatcaagaaaggctggaaaactactgaaaaactgatcaagctggacttgtgcatttatgtttgttttaagacactgcattaaagaaagatttgaaaagtatacacaaaaatcagatttagtaactaaaggttgtaaaaaattgtaaaactggttgtacaatcatgatgttagtaacagtaatttttttcttaaattaatttacccttaagagtatgttagatttgattatctgataatgattatttaaatattcctatctgcttataaaatggctgctataataataataatacagatgttgttatataaggtatatcagacctacaggcttctggcaggatttgtcagataatcaagccacactaactatggaaaatgagcagcattttaaatgctttctagtgaaaaattataatctacttaaactctaatcagaaaaaaaattctcaaaaaaactattatgaaagtcaataaaatagataatttaacaaaagtacaggattagaacatgcttatacctataaataagaacaaaatttctaatgctgctcaagtggaaagggtattgctaaaaggatgtttccaaaaatcttgtatataagatagcaacagtgattgatgataatactgtacttcatcttacttgccacaaaataacattttataaatcctcaaagtaaaattgagaaatctttaagtttttttcaagtaacataatctatctttgtataattcatatttgggaatatggcttttaataatgttcttcccacaaataatcatgcttttttcctatggttacagcattaaactctattttaagttgtttttgaactttattgttttgttatttaagtttatgttatttataaaaaaaaaaccttaataagctgtatctgtttcatatgcttttaattttaaaggaataacaaaactgtctggctcaacggcaagtttccctcccttttctgactgacactaagtctagcacacagcacttgggccagcaaatcctggaaggcagacaaaaataagagcctgaagcaatgcttacaatagatgtctcacacagaacaatacaaatatgtaaaaaatctttcaccacatattcttgccaattaattggatcatataagtaaaatcattacaaatataagtatttacaggattttaaagttagaatatatttgaatgcatgggtagaaaatatcatattttaaaactatgtatatttaaatttagtaattttctaatctctagaaatctctgctgttcaaaaggtggcagcactgaaagttgttttcctgttagatggcaagagcacaatgcccaaaatagaagatgcagttaagaataaggggccctgaatgtcatgaaggcttgaggtcagcctacagataacaggattattacaaggatgaatttccacttcaaaagtctttcattggcagatcttggtagcactttatatgttcaccaatgggaggtcaatatttatctaatttaaaaggtatgctaaccactgtggttttaatttcaaaatatttgtcattcaagtccctttacataaatagtatttggtaatacatttatagatgagagttatatgaaaaggctaggtcaacaaaaacaatagattcatttaattttcctgtggttgacctatacgaccaggatgtagaaaactagaaagaactgcccttcctcagatatactcttgggagagagcatgaatggtattctgaactatcacctgattcaaggactttgctagctaggttttgaggtcaggcttcagtaactgtagtcttgtgagcatattgagggcagaggaggacttagtttttcatatgtgtttccttagtgcctagcagactatctgttcataatcagttttcagtgtgaattcactgaatgtttatagacaaaagaaaatacacactaaaactaatcttcattttaaaagggtaaaacatgactatacagaaatttaaatagaaatagtgtatatacatataaaatacaagctatgttaggaccaaatgctctttgtctatggagttatacttccatcaaattacatagcaatgctgaattaggcaaaaccaacatttagtggtaaatccattcctggtagtataagtcacctaaaaaagacttctagaaatatgtactttaattatttgtttttctcctatttttaaatttattatgcaaattttagaaaataaaatttgctctagttacacacctttagaattctagaatattaaaactgtaaggggcctccatccctcttactcatttgtagtctaggaaattgagattttgatacacctaaggtcacgcagctgggtagatatacagctgtcacaagagtctagatcagttagcacatgctttctactcttcgattattagtattattagctaatggtctttggcatgtttttgttttttatttctgttgagatatagcctttacatttgtacacaaatgtgactatgtcttggcaatgcacttcatacacaatgactaatctatactgtgatgatttgactcaaaaggagaaaagaaattatgtagttttcaattctgattcctattcaccttttgtttatgaatggaaagctttgtgcaaaatatacatataagcagagtaagccttttaaaaatgttctttgaaagataaaattaaatacatgagtttctaacaattagaaaagaaaaaattaaaacatgaaatgataacaaaagtaaacaaaagatactttcaaagcagtgaacaaaacattttgacataagccataatataaattataatataaaaaataaaaaccatagtataaattgtcagcctttgagttggctacaaattcaatttaatgacagaagagaagggatgctggaggtaaattcttagggtttctatctcatagagtttgctcttctggttctctagactgccaaagaacataaagatgtgcgaggggacctagctgtagtaaaagcaatcctataacaagaaaaactctaaaacagtgccccttacgattttctactgaaatttctctaatagtagaggtgtaaaataagaagttagagaataatgcaaagggggcccaccacagacggaacatttcttttctcttaagactcatgtgatttttgcatcttactccataatatatttgtggttgcgttaatatgacaatgtctgcaattaaacaccagtaagcaaaattgatacatcagaatgacttgcagggcttatcatgcagtttggtttacatccctactccactgccatttacttgagcgtgaatgagacacaaaagattatttgcctcccataatccaactttacacataaataacacaaggctaaagaaaaccagaactcaaattcaccacgcataggagtgataacaaaaatatttaacagtcagtatgggtgattactggccaatcagaatacatcactgatacatcgaaatggatgcaggccactatgactaacttgtgggtatcatttctatgatcaccctaaaacagagttgggaaaatatctattaactggtctctctggtttgaattctcaatatgtatcttaatatgaaatagctcattaaaacttcatgtgtaactatttcagcattgttgtcagctactctttattccacttctgtacagtatttattcaaccaagctgctgctttcaatgaaggtcacttgttccttcagggacacatatactcccacctatcctttaattttgaatggtttgtcaggaaaatttactttctcttgagttgaaaaacttgacaggaagcaagaaataatacagtcctagcctctttccaataacatctgatttctccattctcaaactacacttctcaaggaaccagatatttactctcatctgggaagatgcctcttatgttttccttttacttcctggttatcatgtggttgcattttccaagttcttatcattgaatttatgagagcctatcaaaatttattttctttcatttatattctaataattgaaatgtgagatgaaaataacatttcacttatgaaaaacccttctcttgatgaatccttccatgtgttagttatctattgctgtgtaacaaattaaaacttaatggcttgaaacaaa

SEQ ID NO: 356 - DNA, 1390 bp, Homo sapiens
atacggaaaacagaatagaagcacagaacaaggactattgtatataagagaagcaggtgttaatgtaagttgctgtggaatgactgttttcaagaagagagaaggagccaatatatctactttcattaagaagctgaaattaaatttggatttccttctttccaaagctgagacacgatggccaaaaagcgattgctgtgattggagctggaattagcggactgggggccatcaagtgctgcctggatgaagatctggagcccacctgctttgaaagaaatgatgatattggacatctctggaaatttcaaaaaaatacttcagagaaaatgcctagtatctacaaatctgtgaccatcaatacttccaaggagatgatgtgcttcagtgacttccctgtccctgatcattttcccaactacatgcacaactccaaactcatggactacttcgggatgtatgccacacactttggcctcctgaattacattcgttttaagactgaagtgcaaagtgtgaggaagcacccagatttttctatcaatggacaatgggatgttgttgtggagactgaagagaaacaagagactttggtctttgatggggtcttagtttgcagtggacaccacacagatccctacttaccacttcagtccttcccaggcattgagaaatttgaaggctgttatttccatagtcgggaatacaaaagtcccgaggacttttcagggaaaagaatcatagtgatcggcattggaaattctggagtggatattgcggtggagctcagtcgtgtagcaaaacagatttgaccagtaggaactgagattcaacgtccccaagactgcaaaagtacctacaatcaaacaaattaatatatttcctaattggatcagcatgcagacaagtttacaaatatattacagaaagatttgaagagggattctggttacgttcagttaagcaggacactaatcctgaacaatctgatgtattaaagtttctaatgtttgtatctttggtttgatgcatacaatagagtggaagtctgtagtagttaatatgatgataattcgcttctaaatttaaatccttatttatatatgaagcatagctatgtcaatgtccagggaagcatttttaaatagtaaatcagaaacatgtaaactagtgaatacaattttctatttttcattcagaaatttgttgtcatagatgcagcctttatctggaaatcagtgggcagctctggtcaagcacagcatggcgaccactgtgtagtattttaccacctaatccttagtagccaacactgttaaatctgcataatgggtagcatatgaataaaataatatcttgtaaaaaaaaaaaaaaaaaaaaaaaaaaaaaa

SEQ ID NO: 357 - DNA, 6548 bp, Homo sapiens
agtggcggagcgcggctgccggtgtgcggccgggagcgatcgccgcggggcaggggcgcggcgggcaccgcgcagagcgcgcagaacagacggacggcggcggggacccgacggcggcgcctcggcactccccagactccggccagcgcccccctgccagccgcaagcacccagccccggcccaccccgggctctcgatggcccccgaggccggggcgaccctgcgcgcgccgcgccggctgtcctgggcggcgctgctgctcttggccgcgctgctccccgtcgcctcctcggcggcggcctcagttgaccacccactgaagccaaggcatgtgaaactgctgtccactaaaatgggcctgaaagtcacgtgggacccacccaaagatgctaccagtagacctgtggagcattacaacattgcctatgggaagtcactgaaaagtcttaaatacatcaaggtgaatgcggagacatactccttccttattgaggatgtggagccgggggtagtgtactttgtgctgcttactgcagaaaaccacagtggagtgagccgtcctgtttacagagctgaaagcccacctggaggtgaatggatcgagattgatggttttcccattaagggtccaggaccatttaatgaaaccgtcacagaaaaggaagtgcccaacaagcccttgcgtgtgcgtgtccggtcctcagatgacaggctgtccgttgcgtggaaggcaccacgcctgtctggagccaagagtccacgcagatcacggggttttctcctgggctacggggagagtggccggaagatgaattatgttccactgacaagagatgaacggacacacgaaattaaaaagctagcctcggaatccgtgtatgtggtctccctgcagtccatgaactctcagggccggagccaaccagtctacagggctgccctaacaaagcgaaagatttcagaagaggacgaattggatgtacctgacgacatcagcgtccgggttatgtcatctcagtctgtgcttgtgtcctgggtggatcctgttctggaaaaacagaagaaagttgttgcatcaagacagtacaccgtgcgctatcgagagaagggggaattggccaggtgggattataagcagatcgctaacaggcgtgtgctgattgagaacctgattccagacactgtgtatgaatttgcagtccgtatttcacagggtgaaagagatggcaaatggagtacgtcagtcttccaaagaacaccagaatctgcccctaccacagctcctgaaaacttgaacgtctggccagtcaatggcaaacctacagttgtcgctgcatcttgggatgcgctaccagagactgaggggaaagtgaaagaatacattctttcatacgccccggctctcaaaccatttggagcaaagtccctcacctatcctggagacactacttctgccctggtggatggtctgcagcctggggaacgctatcttttcaaaatccgggccacaaacaggagaggcctgggacctcactccaaagccttcattgtcgctatgccaacaaccagtaaggcggatgttgagcagaacacggaggacaatgggaaacccgaaaaacctgagccttcctcaccttctcccagagctccagcttcctcccaacacccctctgtgcctgcttctccccaagggagaaatgccaaggaccttcttcttgacttgaagaacaaaatattggctaatggtggggcgccccgaaaaccccagcttcgcgccaagaaggcagaggagctggatcttcagtcgacagaaatcactggggaggaggagctgggttcccgggaggactcgcccatgtcaccctcagacacccaagaccagaaacggaccctgaggccgccaagtagacacggccactcggtggttgctcccggcaggactgcagtgagggcccggatgccagcgctgccccgaagggaaggcgtagataagcctggcttttccctggccacgcagccccgcccaggggcgcccccctcggcttcggcctctcctgcccaccacgcgtccacccagggcacctctcatcgtccttccctgcctgccagcttgaatgacaacgacttggtggactcagacgaagatgagcgcgctgtgggctccctccaccccaagggcgccttcgcccagccccggccagccctgtcccccagccgccagtccccgtccagcgttctccgcgacagaagctctgtgcaccccggcgcaaagccagcctcgccggcccggaggaccccccattcaggggccgcagaggaagattccagtgcctcagccccaccctcaagactttctccaccccatgggggatcatctcggctgctgcccacccagccacacctgagctctccactttccaagggcgggaaggatggtgaggacgccccagccaccaactccaatgcgccatcacggtccaccatgtcctcctccgtctcttctcatctctcgtccaggacgcaggtctctgagggagcggaggcttctgatggtgaaagccacggtgacggcgatagggaagacggcggaaggcaggcggaggccacggcccagacgctgcgggcccggcctgcctctggacacttccatttgctcagacacaaaccctttgctgccaacgggaggtctccaagcaggttcagcattgggcggggacctcggctgcagccctccagctccccacagtcgactgtgccctcccgagcccaccccagggttccctctcactctgattcccaccctaagcttagctcaggtatccatggagacgaggaggatgagaagccgcttcctgccaccgttgtcaatgaccacgtgccttcctcctccaggcagcccatctcccggggctgggaggacttaaggagaagcccgcagagaggggccagcctgcatcggaaggaacccatcccagagaaccccaaatccacaggggcagatacacatcctcagggcaagtactcctccctggcctccaaggctcaggatgttcaacagagcacagacgcggacacggagggtcattctcccaaagcacagccagggtccacagaccgccacgcgtcccctgctcgtccgcccgcagcacggtcacagcagcatcccagtgttcccagaaggatgacacccggccgggccccacaacagcagccccctcctcccgtcgccacgtcccagcaccacccgggaccccagagcagagacgcgggtcggtcaccttcccagcccaggctctcactgacccaggccgggcggccccgccccacgtcgcagggccgctcccactcctcctcggacccttacacggcgagctccagagggatgctccccacggccctccagaaccaggacgaggatgcccagggcagctacgacgacgacagcacagaagtcgaggcccaggatgtgcgggcccccgcgcacgccgcgcgcgccaaggaggcagctgcgtcccttcccaagcaccagcaggtggagtctcccacaggcgcaggggcaggtggcgaccacaggtcccagcgcggacatgcggcctcccccgccaggcccagccgacccggcggcccccagtcccgcgcccgggtacccagcagggcagcgccggggaagtcggagcctccttccaagcggcccctgtcctccaagtcccagcagtcggtctcagccgaggacgacgaggaggaggacgcgggattttttaaaggcgggaaagaagaccttctgtcttcctctgtgccaaagtggccctcttcctccactcccaggggcggcaaagacgccgatgggagcctcgccaaggaagagagggagcctgccatcgcgcttgcccctcgcggagggagcctggctcctgtgaagcgacctctccccccacctccaggcagctcccccagggcctcccacgtcccttcccgactgccgcctcgcagcgctgccaccgtgagccccgtcgcgggcacccacccctggccgcagtacaccacgcgcgccccacctggccacttctccaccaccccgatgctgtccttgcgccagaggatgatgcatgccagattccgtaaccctctctcccgacagcctgccagaccctcttacagacaaggttataatggcagaccaaatgtagaagggaaagtccttcctggtagtaatggaaaaccgaatggacagagaattatcaatggccctcaaggaacaaagtgggttgtggaccttgatcgtgggttagtattgaatgcagaaggaaggtacctccaagattcacatggaaatcctcttcggattaaactaggaggagatggtcgaaccattgtagatctggaagggacccccgtggtgagtcctgacggcctcccactctttgggcaggggcgacatggcacacctctggccaatgcccaagataagccaattttgagtcttggaggaaagccgctggtgggcttggaggtcatcaaaaaaaccacccatccccctaccactaccatgcagcccaccactactacgacgcccctgcctaccactacaaccccgaggcccaccactgccaccacccgccgcacgaccaccacccgccgcacgaccaccaggcgtccaacaaccacagtccgaaccactacgcggacaaccaccaccaccacccccacacccaccactcccatccccacctgtccccctgggaccttggaacggcacgacgatgatggcaacctgataatgagctccaatgggatcccagagtgctacgctgaagaagatgagttctcaggcttggagactgacactgcagtacctacggaagaggcctacgttatatatgatgaagattatgaatttgagacgtcaaggccaccaaccaccactgagccttcgaccactgctaccacaccgagggtgatcccagaggaaggcgccatcagttcctttcctgaagaagaatttgatctggctggaaggaaacgatttgttgctccttacgtgacgtacctaaataaagacccatcagccccgtgctctctgactgatgcactggatcacttccaagtggacagcctggatgaaatcatccccaatgacctgaagaagagtgacctgcctccccagcatgctccccgcaacatcaccgtggtggccgtggaaggttgccactcatttgtcattgtggactgggacaaagccaccccaggagatgtggtcacaggttacttggtttacagtgcatcctatgaagacttcatcaggaacaagtggtccactcaagcttcatcagtaactcacttgcccattgagaacctaaagcccaacacgaggtattattttaaagtgcaagcacaaaatcctcatggctacggacctatcagcccttcggtctcatttgtcaccgaatcagataatcctctgcttgttgtgaggcccccaggcggtgagcctatctggatcccattcgctttcaaacatgatcccagctacacggactgccatggacggcaatatgtgaagcgcacgtggtatcgaaagttcgtgggagttgttctttgtaattcactgaggtataaaatctacctcagtgacaacctgaaagatacattctacagcattggagacagctggggaagaggtgaagaccattgccaatttgtggattcacaccttgatggaagaacagggcctcagtcctatgtagaagccctccctactattcaaggctactatcgccagtatcgtcaggagcctgtcaggtttgggaacatcggcttcggaaccccctactactatgtgggctggtacgagtgtggggtctccatccctggaaagtggtaatcacaggaccgtcatgctgcaagcttgccctgcccagccccaccaactaagtcgcactaggggctgtgagcaaagacagccagcgtgctcagccccgctgccctaggtgccaggaaggtcatagatggacactggccattctggtcatctcagtctggaactcagtcccacttcttggcctggacaatgaacaggattcagttttgctgttaactttgcttctctacttttttttgtttgtttgtaatagcacatcccagagacatcagaaaccagcaactgattcagtgtgatttccagactttttaggcatgaaattcggacacttcagtatttccaggaatagcatatgcacgctgttcttgcttcatggaatgctacatgctttctgtttttctcattttggatttctccaaaactaactgaatttaagcttcaggtccctttgtatgcagtagaaaggaattattaaaaacaccaccaaagaaaataaatatatcctacttgaaatttactctatggacttacccactgctagaataaatgtatcaaatcttatttgtaaattctcaattttgatatatatatgtatatatgcatatacatatccacacttgtctgcaagaatattgattaaaattgctaaatttgtacttgttcaccaga

SEQ ID NO: 358 - DNA, 5499 bp, Homo sapiens
gatccgtcacgggcgccgccgctgccgccgccgccgccgcggccgttctgagccgagccggaaccctagcccgagacggagccggggcccgggccggcgccattgcgcgggcgccgcgggaagaccttggcgcggggcggcgggccgggccaggccatgcgggccgagtgagccggcgcccgcagcccgcggcgcggcatggcttccccgcggagctccgggcagcccgggccgccgccgccgccgccaccgccgcccgcgcgcctgctactgctactgctgctgccgctgctgctgcctctggcgcccggggcctggggctgggcgcggggcgccccccggccgccgcccagcagcccgccgctctccatcatgggcctcatgccgctcaccaaggaggtggccaagggcagcatcgggcgcggtgtgctccccgccgtggaactggccatcgagcagatccgcaacgagtcactcctgcgcccctacttcctcgacctgcggctctatgacacggagtgcgacaacgcaaaagggttgaaagccttctacgatgcaataaaatacgggcctaaccacttgatggtgtttggaggcgtctgtccatccgtcacatccatcattgcagagtccctccaaggctggaatctggtgcagctttcttttgctgcaaccacgcctgttctagccgataagaaaaaatacccttatttctttcggaccgtcccatcagacaatgcggtgaatccagccattctgaagttgctcaagcactaccagtggaagcgcgtgggcacgctgacgcaagacgttcagaggttctctgaggtgcggaatgacctgactggagttctgtatggcgaggacattgagatttcagacaccgagagcttctccaacgatccctgtaccagtgtcaaaaagctgaaggggaatgatgtgcggatcatccttggccagtttgaccagaatatggcagcaaaagtgttctgttgtgcatacgaggagaacatgtatggtagtaaatatcagtggatcattccgggctggtacgagccttcttggtgggagcaggtgcacacggaagccaactcatcccgctgcctccggaagaatctgcttgctgccatggagggctacattggcgtggatttcgagcccctgagctccaagcagatcaagaccatctcaggaaagactccacagcagtatgagagagagtacaacaacaagcggtcaggcgtggggcccagcaagttccacgggtacgcctacgatggcatctgggtcatcgccaagacactgcagagggccatggagacactgcatgccagcagccggcaccagcggatccaggacttcaactacacggaccacacgctgggcaggatcatcctcaatgccatgaacgagaccaacttcttcggggtcacgggtcaagttgtattccggaatggggagagaatggggaccattaaatttactcaatttcaagacagcagggaggtgaaggtgggagagtacaacgctgtggccgacacactggagatcatcaatgacaccatcaggttccaaggatccgaaccaccaaaagacaagaccatcatcctggagcagctgcggaagatctccctacctctctacagcatcctctctgccctcaccatcctcgggatgatcatggccagtgcttttctcttcttcaacatcaagaaccggaatcagaagctcataaagatgtcgagtccatacatgaacaaccttatcatccttggagggatgctctcctatgcttccatatttctctttggccttgatggatcctttgtctctgaaaagacctttgaaacactttgcaccgtcaggacctggattctcaccgtgggctacacgaccgcttttggggccatgtttgcaaagacctggagagtccacgccatcttcaaaaatgtgaaaatgaagaagaagatcatcaaggaccagaaactgcttgtgatcgtggggggcatgctgctgatcgacctgtgtatcctgatctgctggcaggctgtggaccccctgcgaaggacagtggagaagtacagcatggagccggacccagcaggacgggatatctccatccgccctctcctggagcactgtgagaacacccatatgaccatctggcttggcatcgtctatgcctacaagggacttctcatgttgttcggttgtttcttagcttgggagacccgcaacgtcagcatccccgcactcaacgacagcaagtacatcgggatgagtgtctacaacgtggggatcatgtgcatcatcggggccgctgtctccttcctgacccgggaccagcccaatgtgcagttctgcatcgtggctctggtcatcatcttctgcagcaccatcaccctctgcctggtattcgtgccgaagctcatcaccctgagaacaaacccagatgcagcaacgcagaacaggcgattccagttcactcagaatcagaagaaagaagattctaaaacgtccacctcggtcaccagtgtgaaccaagccagcacatcccgcctggagggcctacagtcagaaaaccatcgcctgcgaatgaagatcacagagctggataaagacttggaagaggtcaccatgcagctgcaggacacaccagaaaagaccacctacattaaacagaaccactaccaagagctcaatgacatcctcaacctgggaaacttcactgagagcacagatggaggaaaggccattttaaaaaatcacctcgatcaaaatccccagctacagtggaacacaacagagccctctcgaacatgcaaagatcctatagaagatataaactctccagaacacatccagcgtcggctgtccctccagctccccatcctccaccacgcctacctcccatccatcggaggcgtggacgccagctgtgtcagcccctgcgtcagccccaccgccagcccccgccacagacatgtgccaccctccttccgagtcatggtctcgggcctgtaagggtgggaggcctgggcccggggcctcccccgtgacagaaccacactgggcagaggggtctgctgcagaaacactgtcggctctggctgcggagaagctgggcaccatggctggcctctcaggaccactcggatggcactcaggtggacaggacggggcagggggagacttggcacctgacctcgagccttatttgtgaagtccttatttcttcacaaagaagaggaacggaaatgggacgtcttccttaacatctgcaaacaaggaggcgctgggatatcaaacttgcaaaaaaaaaaaaaaaaaaaaaaaaacaaaaaaactagacaaggagagaggcactagaactccagctggaagtcacggagtggctcgagcagccttgggaagaggcaaggagcttctgaagaaactgcctctgcacacacatcactggctgtgacccctcaggctagcccttctccactctgggggaggaggtgggaagggccaccaggcccccagctgccaggccagctgaccccagccttcctggaacagggagtctgcaggagcgcagacaggcacagccctggagcaggcaggccgagggctgcggcactggagcaggctgacttacatgctccacatgggacctgtgtcacccaatgagatgtttgttactctggtaaatgccacacgttaacacaataacacccattcctgggaccgtggggatttagggcacgtcactgcagacacgctctgcagcattcaccgacagtctgtcatgcacccaccacgttggccatgtccttgtgttcctatcggatgctcccagtaaccagggggaccacccgagctaatcatggaatgtctgttcccagcaaacacgataaagaaagattgtgcactttaacctctctcatcagggcccaagggctggctgggattttttttttttttttcccactaactttgtttctgaccaaagtgaattggaggcactctgctaaaagacatccccgtagacataggggagagagttgctggctgagggcttcccttggcttccagaaggcagccttccatccagacaagccagtgagctctccccttgggatcactggggtgatcagtcagcagattgattctcattcataagatcattcctccctttaaattgagcccctaagagcactggcctgggagtcagacagacctgggttcaagtcctcagtcccctgcccactccctacgtgactttgatcaggtcactagtgtctctctgagcctcagtttcccctctgtaacttggggttgaactaaaacacctgtcctgcctacctcacaaggtcactctgaggattgaaacttgatcttgtccaggaaagctttgtaccaaacagtgaagccgccctgatccgtgaggtatgagtatgactctgaccttcagccctccctacagccgggggtgtggcccagagaagcttccagcacagccctctacccagaacatccgggctggagggaggctcccagtgacttttctgacattcctagacaggttcattctttgctcaagaaaggcctgaatgacaatgtccaggatgtctgcacaactgagcagctcgctcactccctaaagaaacctattggcagcttcaacaggcaggcaataatctcttcccagaaccactgcagtcaggaataaactgttttctccaccaggctttgacaaaagggcccacaggaatcttaccaatgccaacatttcaaagcaccctatttcacgtagcatagctttctgctccccttccccaaagagaggttatggaggtactgtagcttttagggaaaaaaaaatgttaacacatcacaggtcaagttgaagtcattctctgtttaggcactaaaaatcggtgttgtcactcactgtgtattaccagtatttacttgctttcttgatttcaccaaaaccaaatttaatttaaaggaccacattaatttttcaaagggaaagagacaattaattgtacataatgtatacacacacacaaaaaaaaatacctgtagaaatattattccagcatagcaggaaaacaaacaaaagtattggactgtcggaggtgagcctgtgcgtctgtaaccctttgtgactcctgagcgtgcgctgtcttctaggttaactcacgaagtacattctctgtcttactgatactgtaggttcacccatttttttttaatttcctcgcaaataacaagacccacagaagtgactctagctacttaatggttctgttcttttatatgcagcaaacacaccgtccatttctgaagaggcttcggcctgaaggcattttccaatgatgttagtgcacaaaacgctttaaattagactggaactgccagaatcaaatgtaaatgaggaatttctcgtacccctactgcatggtatcgatttttaataaattgttgcaaatttgtttttatgaa

SEQ ID NO: 359 - DNA, 3034 bp, Homo sapiens
agctggagcccgcggagcccacggagcccacggagcccacggaggagcccacggaggagccccagcgtccgaacgggcagaccccctcgagccgcgaaggagcccgagaagcagccacgatgtgcggaatctttgcctacatgaactacagagtcccccggacgaggaaggagatcttcgaaaccctcatcaagggcctgcagcggctggagtacagaggctacgactcggcaggtgtggcgatcgatgggaataatcacgaagtcaaagaaagacacattcagctggtcaagaaaagggggaaagtcaaggctctcgatgaagaactttacaaacaagacagcatggacttaaaagtggagtttgagacacacttcggcattgcccacacgcgctgggccacccacggggtccccagtgctgtcaacagccaccctcagcgctcagacaaaggcaacgaatttgttgtcatccacaatgggatcatcacaaattacaaagatctgaggaaatttctggaaagcaaaggctacgagtttgagtcagaaacagatacagagaccatcgccaagctgattaaatatgtgttcgacaacagagaaactgaggacattacgttttcaacgttggtcgagagagtcattcagcagttggaaggtgcattcgcgctggttttcaagagtgtccactacccaggagaagccgttgccacacggagaggcagccccctgctcatcggagtccggagcaaatacaagctctccacagaacagatccctatcttatacaggacgtgcactctggagaatgtgaagaatatctgtaagacacggatgaagaggctggacagctccgcctgcctgcatgctgtgggcgacaaggccgtggaattcttctttgcttctgatgcaagcgctatcatagagcacaccaaccgggtcatcttcctggaggacgatgacatcgccgcagtggctgatgggaaactctccattcaccgggtcaagcgctcggccagtgatgacccatctcgagccatccagaccttgcagatggaactgcagcaaatcatgaaaggtaacttcagtgcgtttatgcagaaggagatcttcgaacagccagaatcagttttcaatactatgagaggtcgggtgaattttgaaaccaacacagtgctcctgggtggcttgaaggaccacttgaaggagattcgacgatgccgacggctcatcgtgattggctgtggaaccagctaccacgctgccgtggctacgcggcaagttttggaggaactgactgagcttcctgtgatggttgaacttgctagtgattttctggacaggaacacacctgtgttcagggatgacgtttgctttttcatcagccagtcaggcgagaccgcggacaccctcctggcgctgcgctactgtaaggaccgcggcgctctcaccgtgggcgtcaccaacaccgtgggcagctccatctctcgcgagaccgactgcggcgtccacatcaacgcagggccggagatcggcgtggccagcaccaaggcttataccagtcagttcatctctctggtgatgtttggtttgatgatgtctgaagaccgaatttcactacaaaacaggaggcaagagatcatccgtggcttgagatctttacctgagctgatcaaggaagtgctgtctctggaggagaagatccacgacttggccctggagctctacacgcagagatcgctgctggtgatggggcggggctacaactatgccacctgcctggaaggagccctgaaaattaaagagataacctacatgcactcagaaggcatcctggctggggagctgaagcacgggcccctggcactgattgacaagcagatgcccgtcatcatggtcattatgaaggatccttgcttcgccaaatgccagaacgccctgcagcaagtcacggcccgccagggtcgccccattatactgtgctccaaggacgatactgaaagttccaagtttgcgtataagacaattgagctgccccacactgtggactgcctccagggcatcctgagcgtgattccgctgcagctgctgtccttccacctggctgttctccgaggatatgacgttgacttccccagaaatctggccaagtctgtaactgtggaatgaggctgagaccgtgacaagaccatcaccacctttcatctgattccagacctgtcccaacagcagggatgctacatgggaagagaagtggacatcccacatgttctgcgtgctcctgtagagcttgacagcttccacgtgccttctacccaagtgcttttgcttacagcagatactgtttctctgtgtcctgaagtcgccagaggagaagggaatcattgtttacacatggggatcagagcagacttctccactactgtgcaatagagatacagctctcttcagagtaactgtgaaccttttataaccaacactagagttagttttaaaagacaagatatttataatgacgactgtatagcttttaagttatttttctagtatgtggctttctgtagccgtggtaacggccaaactgttcatcctagctacccatgctctgtgtccaggcttgctcctggcaggtggcattcatctcagatgtgagcacaaggcattggccctctggactcctttctccttttctttcctctctaggctgctcctgaatcctgttctctgacatccgtggagcccctcctgcatccacctatgcctcctataagtccagttgaaatctcagcctccttcaacattttcttctcgtgtgtggcccacatccctccacttctccaacttctgtttaatctgatcacggctctttttaagccctggcagcattttggtccctgctccttgcccatagtaaaacagcttgaaatatcccatgcaagagagtagtttcaagtgggcaactctgctctctatttaaaagcgtgcacaatcaaaagtactatgcaattttaggacaataaagaacatacagtttt

SEQ ID NO: 360 - DNA, 2626 bp, Homo sapiens
gagacacagccggaaaggctggcaggcaggagggctggggcgagcactggggggccatggagcgggcagaagagcccgtggtctatcagaagctgctgccctgggagccaagcttggagtcggaggaggaagtggaggaggaggagacatcagaggcgctggttctaaacccccggaggcaccaggactcttccaggaacaaggctggcgggctgcccggaacctgggcccgtgtagtggcagccctgctgctgctggctgttggctgctccctggctgtgaggcagctccagaatcagggcaggtcgacaggaagcttgggctctgtggcccctccacccggcggacactcccacggccctggcgtataccaccacggtgccatcatcagccctgcaggccgagagctgcttgttgccgggggcaacgtcgtggatgctggagttggagctgcattgtgcctggcagtggtgcatcctcatgccacggggctaggtgccatgttttggggcctcttccacgatagctcctcaggcaattccacggccctgacatcaggcccagcacagaccctggcccccggcctggggctgcccgcggctctgcccaccctgcacctgctgcatgcacgcttcggccgcctgccctggccacgcctgctagtgggccccaccacgctggctcaggagggcttcctggtggacacacccctggcaagggctctggtggctcggggcacagaaggcctctgtccactactttgccatgctgatgggacacccctgggcgctggggcccgagccaccaacccacaactggcagctgtgcttcgcagcgcagccctcgctcccacctcagaccttgctggggatgctctactgagtctactggcgggagacctgggggtggaggtgccctcggctgtgcccaggcccactttggaaccagcagagcagctacctgtgccccagggcatcctgttcaccacccccagtccctcagctggcccagaactgctggcactgttggaggcagccctgcgctccggggcgcccatccctgacccctgcccaccgttcctgcagactgctgtgagccccgagagcagtgccctggccgccgtggacagcagcggctctgtgctccttctcacctcctcgctcaactgctcctttggctctgcacacctgtccccaagcactggggttctgctcagcaacctggtggccaagtctaccactagtgcctgggcctgccccctcatcctccgtggcagcctggatgacacagaggctgatgtgttggggcttgtggcttcagggacccctgatgtggccagggccatgactcacaccctactcaggcatctggcagcaaggccccctacccaggcccagcaccagcatcagggtcagcaagaaccaacagagcatcccagcacttgtggccaagggaccctgctccaggtggcagcccacacagagcacgcccatgtctccagtgtcccccatgcctgctgccccttccaggggttctaacaggatgggggtgggtctggcagaaggcagagttatctgaagcatgggggcaggagcagagcagacacagcagcaatggagtgtgcacccgcagggtgtggtgcctcacacctgtaatctcagcactttgggtggtcaaggcaggaagatacctcgaggccaggagtttgaaactagcctagacaacaaagcaagatctcatctgtactaaaaatttaaaaatttgccaggggcggtggcacatgcctgttgtcccagctgcttgggaggctgaggcaggaagctcgcttgagctcaggagttcaaggctgcagagagctaggatcacaccactgcactccagcctggacaacagagtgagaacctgtctttaaaataataataataataataaaaaaatagctgggtgcggtggctcatgcctgtaatcccagcactttgggaggccaaggcaggtggatcacctgaggctaggagttcgagaccagcttgggcaacatggcgaaaccccgtctctactaaaaatacaaaaaattagctgggcatggtggcgggcacctgtaatcccagctacttgggaggctgaggcaggagaatcacttgaacccgagaggtggaggttgcagtgaaccaagatcgcaccattgcaaccccacctgggcaacaagagggaaaccctgtctaaaaaaaaaaaaaaaaaaaaggatttattatgtgctcactgctggctcaggccccaacctctggccttttaagttacctagacttgagttctggcatccagagctaacaatcattcttcagatcacccacaccggatggaatctctagctattttatcagctaagaaaatcagggtaataacgaaaaagcagtagggcctggggctagcactgagttcagatccagctttcaggaggacagtggaaagagtgcagagcctctgcctaggccctgggccccacgaagcaggacaggcagagcccagggtactgttggcatctctgtccttcccttcaggacaccccttacctatctgcctcaaccagactgggtacaaaataaagatcaagtctcccggaaaccaa

SEQ ID NO: 361 - DNA, 14575 bp, Homo sapiens
actcggtgcgccttccgcggaccgggcgacccagtgcacggccgccgcgtcactctcggtcccgctgaccccgcgccgagccccggcggctctggccgcggccgcactcagcgccacgcgtcgaaagcgcaggccccgaggacccgccgcactgacagtatgagccgcacagcctacacggtgggagccctgcttctcctcttggggaccctgctgccggctgctgaagggaaaaagaaagggtcccaaggtgccatccccccgccagacaaggcccagcacaatgactcagagcagactcagtcgccccagcagcctggctccaggaaccgggggcggggccaagggcggggcactgccatgcccggggaggaggtgctggagtccagccaagaggccctgcatgtgacggagcgcaaatacctgaagcgagactggtgcaaaacccagccgcttaagcagaccatccacgaggaaggctgcaacagtcgcaccatcatcaaccgcttctgttacggccagtgcaactctttctacatccccaggcacatccggaaggaggaaggttcctttcagtcctgctccttctgcaagcccaagaaattcactaccatgatggtcacactcaactgccctgaactacagccacctaccaagaagaagagagtcacacgtgtgaagcagtgtcgttgcatatccatcgatttggattaagccaaatccaggtgcacccagcatgtcctaggaatgcagccccaggaagtcccagacctaaaacaaccagattcttacttggcttaaacctagaggccagaagaacccccagctgcctcctggcaggagcctgcttgtgcgtagttcgtgtgcatgagtgtggatgggtgcctgtgggtgtttttagacaccagagaaaacacagtctctgctagagagcactccctattttgtaaacatatctgctttaatggggatgtaccagaaacccacctcaccccggctcacatctaaaggggcggggccgtggtctggttctgactttgtgtttttgtgccctcctggggaccagaatctcctttcggaatgaatgttcatggaagaggctcctctgagggcaagagacctgttttagtgctgcattcgacatggaaaagtccttttaacctgtgcttgcatcctcctttcctcctcctcctcacaatccatctcttcttaagttgatagtgactatgtcagtctaatctcttgtttgccaaggttcctaaattaattcacttaaccatgatgcaaatgtttttcattttgtgaagaccctccagactctgggagaggctggtgtgggcaaggacaagcaggatagtggagtgagaaagggagggtggagggtgaggccaaatcaggtccagcaaaagtcagtagggacattgcagaagcttgaaaggccaataccagaacacaggctgatgcttctgagaaagtcttttcctagtatttaacagaacccaagtgaacagaggagaaatgagattgccagaaagtgattaactttggccgttgcaatctgctcaaacctaacaccaaactgaaaacataaatactgaccactcctatgttcggacccaagcaagttagctaaaccaaaccaactcctctgctttgtccctcaggtggaaaagagaggtagtttagaactctctgcataggggtgggaattaatcaaaaacctcagaggctgaaattcctaatacctttcctttatcgtggttatagtcagctcatttccattccactatttcccataatgcttctgagagccactaacttgattgataaagatcctgcctctgctgagtgtacctgacagtagtctaagatgagagagtttagggactactctgttttagcaagagatattttgggggtctttttgttttaactattgtcaggagattgggctaaagagaagacgacgagagtaaggaaataaagggaattgcctctggctagagagtagttaggtgttaatacctggtagagatgtaagggatatgacctccctttctttatgtgctcactgaggatctgaggggaccctgttaggagagcatagcatcatgatgtattagctgttcatctgctactggttggatggacataactattgtaactattcagtatttactggtaggcactgtcctctgattaaacttggcctactggcaatggctacttaggattgatctaagggccaaagtgcagggtgggtgaactttattgtactttggatttggttaacctgttttcttcaagcctgaggttttatatacaaactccctgaatactctttttgccttgtatcttctcagcctcctagccaagtcctatgtaatatggaaaacaaacactgcagacttgagattcagttgccgatcaaggctctggcattcagagaacccttgcaactcgagaagctgtttttatttcgtttttgttttgatccagtgctctcccatctaacaactaaacaggagccatttcaaggcgggagatattttaaacacccaaaatgttgggtctgattttcaaacttttaaactcactactgatgattctcacgctaggcgaatttgtccaaacacatagtgtgtgtgttttgtatacactgtatgaccccaccccaaatctttgtattgtccacattctccaacaataaagcacagagtggatttaattaagcacacaaatgctaaggcagaattttgagggtgggagagaagaaaagggaaagaagctgaaaatgtaaaaccacaccagggaggaaaaatgacattcagaaccagcaaacactgaatttctcttgttgttttaactctgccacaagaatgcaatttcgttaacggagatgacttaagttggcagcagtaatcttcttttaggagcttgtaccacagtcttgcacataagtgcagatttggctcaagtaaagagaatttcctcaacactaacttcactgggataatcagcagcgtaactaccctaaaagcatatcactagccaaagagggaaatatctgttcttcttactgtgcctatattaagactagtacaaatgtggtgtgtcttccaactttcattgaaaatgccatatctataccatattttattcgagtcactgatgatgtaatgatatattttttcattattatagtagaatatttttatggcaagatatttgtggtcttgatcatacctattaaaataatgccaaacaccaaatatgaattttatgatgtacactttgtgcttggcattaaaagaaaaaaacacacatcctggaagtctgtaagttgttttttgttactgtaggtcttcaaagttaagagtgtaagtgaaaaatctggaggagaggataatttccactgtgtggaatgtgaatagttaaatgaaaagttatggttatttaatgtaattattacttcaaatcctttggtcactgtgatttcaagcatgttttctttttctcctttatatgactttctctgagttgggcaaagaagaagctgacacaccgtatgttgttagagtcttttatctggtcaggggaaacaaaatcttgacccagctgaacatgtcttcctgagtcagtgcctgaatctttattttttaaattgaatgttccttaaaggttaacatttctaaagcaatattaagaaagactttaaatgttattttggaagacttacgatgcatgtatacaaacgaatagcagataatgatgactagttcacacataaagtccttttaaggagaaaatctaaaatgaaaagtggataaacagaacatttataagtgatcagttaatgcctaagagtgaaagtagttctattgacattcctcaagatatttaatatcaactgcattatgtattatgtctgcttaaatcatttaaaaacggcaaagaattatatagactatgaggtaccttgctgtgtaggaggatgaaaggggagttgatagtctcataaaactaatttggcttcaagtttcatgaatctgtaactagaatttaattttcaccccaataatgttctatatagcctttgctaaagagcaactaataaattaaacctattctttctgtgtgtgtgagcgtgcgtttgtgtttggtagtgttcctagggcagaggtggagcagggatgcacttatcatgggaagggaggtagaaaagagaattggatagcctgtgatctttggtggaatttattccttttgcctaggcctttcagaccctgcttgatttccgtaggacacttcaggttgtggcaagggagagctggtctgcaatcggaagtaccagcctcttccctagagcacaactagaaagaagaactatagagtgttataagggaggccctgagatggaaggaccatcacacagaaatgataatatcttcatttcagggtgttccaggggaaaagcaggagaaagatttggggctcagtagaaggaaaagcttcctagtggtaagagtgattggcaataccatgaggtacctttaaaagatagtgaactcctgtccttggaaatattaaaccacaggctagatatcatttaatagggatgtgaagtagagtaagtcactgcccttggtgtgcaattgtgaacttgtcaatttctgaggtccctttctacttagatatataatacaagatttctattaggtatgggtgctctgatgataatgaaaatcccagcagctatgtatgggatggttacaccagacactgtgctaaggattttctttgaattgtttctcactcaatcttcacggtagctcagtgaggtaggtaccattatcactgctagaaagcagtgaacttatatggtcttactgtggcactgggtccttaaacattatgcaaaactgtgagcaacttttatcggtttgttcttttaagaacataacacagcactctaaaaatagatctaactagattgttcacatctagcgattaaggccaccctgagattatagctgcatcatcaggaacccaagatctgaagcattcagtcaaagcctcttggccacctctctttttgtcatggccttcttggacttggagggggagaatggaagcaagtaccaaggagaaagtgttctcagaaaagccacacccattagaaaaatacaaggcctgaaaggtgtgagtgggacttgacacggaagagcatttcaagcttaagaaaaaaaaaaaaaagaagaatgtgggaggatgtcagcaacaatgcttgagattccctggtcccccaaagagtctctcctccataaaactaatgagaatgtgacaaaaatagattcaacttcttatagctctggaaattaactgaagatgtatagcaatttgcagagcatttattcaagaaaaagactaaatctctgtgagcactgtgatattgtaacttgcactactctcatctccccctctccagctccacaatagctttgaaaccaacagcctgcaattaccatgaaaatcagcagtctggcagccactgaaggtgacagaatggagttggagttctttcaaagtcccattcctagacaattgtcactatttgacctgtttggcaggccctggaagctccacttgcaaggctatatttgacctgactggaagcttcccagggtaaaaaactttgtcaaaacaactagaggcaattgattctctttgtggctgcctggggtaatgtataacagttggggaaagcaattggctaaataaaaagcctaaaaggagaagctggaaaaagagattttcatagggactttgaaaagctccaaagtgttattggcaatctagactgccaaatgcataaataggactccatccatgcccaggactgtgcagatgctcaggaaaaacccaagaaagccttaagctctcacttcaagctgatcttgaggctctgcacaagccataagtaaagggaatgcagagttgtcaattgcatggcggagtgttgagtgtgcctcagcattcacacagagctccttggcagagactggttgaattattgattccaagtgtttgaggaaatccgtgtacaactattagatgactactaaccaagcagagacttcagtgtccacacacaacaaaaaatacagactttacagaattagttcagaaaagtcattaaacaaagaaacaacaacaaaccctggggaaatgacagtacgatcaaaccatgcatggccctgcctgcatgtgggaatcctcatccaagtcatactttctaaacatcataaaaagcccaaaccagtctcctttcctggctctctcaagtcattttcagaccaggttaggagacgtgagctgctctccacaaaaagcctcatgtgagtaataaatgtttcatactctcttggggtgtgtgtaacatcatcagtctcagcatctaaaccaaattttggtgacatttcatcttgtttatgcagatgtccaccacacctataaataaacaaactactgaaactgattcaagaaaaaataaaaatctgaatagagctatcacaagtaaagagattaaataagcaatcaaataacttcccagaaagaaaagcccaatttaggatgtcttaactgattaatgttagcaaatatttaaagaagaattggtacaaattcttcacaaactcttccagaaatggaagaggaggaaacactttccaccttattttctataactagtattaccttgataccaaattctgacaaatacatcaaaaataaaaccatagaccaatatctcttttaagtgtaaatgcaaaaaaattcaacaaaatgctagataactgggtccaacaacatatggaaaggattatataccttgaccaagtgggatttgccccaggaatgcaagattgatttaaccatcagtgtaatgcatcatattaatagaataaagacagaaaccacacaatcatctcgatacacgcagaaaaatcatttggcaaaattcaacacccctttgtaataaaatcactcaacacactaggaagagaagggaacttcttcaacctcacacatggcatctatgaaaaacccacagctggccgggtatggtggctcaagcctgtaatcccagcactttgggaggctgagccaggcggatcacctgaggtcaggagttcgagaccaacctgaccaacatggagaaaccctgtatctactaaaaatacaaaaaattagcccggcgtggtggcaaatgcctgtaatcccagctgcttgggaggctgaggcaggagaatcggttgaacccaggaggtggaggttctggtgagccgagatcacgccattgtactccagcctgggcaacaagaacaaaactctgtctcaaaaaaaaaaaaaaaaagaaaagaaaaacccacagctaacatcatacttaaaggtgaaagactgaaagctttcccccaagaggaactaacaggatatctgctgtcactatttttattcaatattatactggaggttctacctagggtaattaggcaaaaaaaaaaaaaaaaaaaaaaaaaaaaaaaaaaaaaaaaaaaaaaaaaagaaaagaaaaaagtcatccagattggaaaagaaataaaatgatttcaattttaagatgacataatattgtatgtagaaatcctaaggaatttacaaaagaactattagagctaatacatgatttcagcaaggttgcaggatacaagatcaacatacagatataaattgtattctacacacttgtaatgaaaaatctgaaaataaaattaagaaaatagcaccctttgaatagtatcaaaaagaataaaatacatagaaaaaatgtaacaggaagtgcaagactggtacattgaaaacaataaaacattgttaaaaaatttaaaatcatcaaaatagatggaaataaaacctgtgttcatggatgaaaaaaattaacattgctctacagattcaatacaattcttatcaaaatcccaggtggcttaagaaattgacaagttaatcctaaaattcataagaaattgaaagggatccacaatagccaaaataatcttaaaaaagattttaaaaagttggagaactcacacttcctggtttcataacatacaccaggctgggcatggtggttcatgcccataatcccagcactttgggaagttgaggcagaaggatcacttgagcacaggagtttgagaccagcctggacgatatagtgagaccttgtctctactaaaaatttaaaaaggaattagccaggtgtggtaacatgcacctgttgtcccagctacttaggaggctgaggcatgaggatcacttgagcccagaagattgtaccactgcactccagcctacatgacagagtaagtctctgtctcaaaaacaaaacaaacaacaaaaatactgaaagctttccccatacaggaactaacaggatatctgctgtcactatttttattcaatattgttctggaggttctagctagggcaattaggcaaaaaaaggaaaaagaagtcatccagattagaaaagaaataaaataatttcaattttcagatgacataatattgtatgtagaaatcctaaggaatttacaaaagaactgctaccctgaaagaattgttgtaaggcaaatacccctgtaattaccattaggggaagaaatttttccatgcttcacagaaactctccttataccccacctcaattttaatctttttctgtaccactacagttataattctcctaaagcttaaagcaattacctccttgtttatatttatagtttcatcactgaagtgtgcattcctaaactcaacaccttagtctggttgcaaacagtttaaatgagaaaagataaggcctgaattaaggcagcagccctaaacctttttctataatcctgatagtgattaccacctaggggattataaatgtttgcttcttcctctggcaccaacaagtttactgagcagaagtttaaaataattggataatggggcaggtgacatcagcaagatgttgtattagcaaatgctggacccttcttcaatccacaaacacatctattctgcaaaaattcatggctaaattcctttgtgaggaatccagaaactaaaaggctcctgcactcccagcaaatgcaaaaaccagactcaccaaagctggtagagagatttgagataccaccttgtccgaatccctaaccccagcacagtgccatgtagtcagcaagagactccctagcactcagtttctcccaggtgagaggagttggttcacatatccaagacctccaacttttctgaggagattcccagaggactggcttctatcttgtcagtcttggagctctgacagaattggtactatctagctacctggggaaggacagagacagaggtttagaccagtagatgacatggcaccctgccctctactgcctcacctcctggctcagcacagacaggacaaaaatcatggctacctacatttccctggagaaggaatgatttgttaaaggcccccaaatcactgggcagacttattggtgggggtcttctcctctgaggcccagctgtgaggactgggacaggtgactgctttgtctaatgtgcagacaccaacacaaagagtcaaggaaaatgaataatcatacgaagatgttccaaaccaaagaacaagataaatctctggaaactgagctaatgaaataaacttatgtgatttacctgacagagaattcagaatagctctcataaagattctcaccagagtcaagagaacaatgcatgaaaaaagttaagaattttgacaaagagatagagtatatttaaaagtaccaaaaagaaatggaactgaagaacacaacaactgaactgaaaaaatttatgacaggacatcaacaggagacaagattaatcagaagaaagaatcaatgaacttgaagacaggtcattggaaataattcagttagaggagaaattaaaatgaaaaagagtgaaaaaaagcccaagggtcttatgggcaacatcaagctgaacaatatactcattattggcatcacagaataaaagagagaaaagaactgagaacgtattcaaagaaataatggctgaacacttcccaaatatgaggaagaaaatgaacattctgatccaagaagcccaaaggtcataaaaaagtgatcccaaagcctacaggcatattataagttgtcatcctagagaaagaaaaatatctttctcccagcctccatattcaaatcttaaggaaaattcttatggacttagcttgagtttcaagttcatttctaaaatcaatcatggtggccaaacggaatgagcattctgatttgccagtgtggtctcatgttacccctgtgcctagaaaggaaacaggagatgaaaagcatggtgataagaagactggatggcaccacatgggatagggggaaagtagttgaaaaaaaatagttgtaaggaaaagagatacaaggagtcaaaaataacaaatatctacttaaaagccttttccacatttaatgttttttgttcactgtggtgtagtaataaatgtctatacttaaggggtgaggattgatatatttaaagtgaatggtctggaaggcaaggaagctcattccaacagattcatgctacattgtttagtgacaaataaggggaacagaacagagaaagtgatttcagctataaatataggagataataaaatcctttagtaaacagtatctaagccttgtttttatgatattggggaacagtaacagatcaaagtactgtagtcttcagtatgcagacctttcactttcttagtttattccagggtcttttttttttttgctgctattacaaatagcattgttttcctaatttttgtttaagatagttcatcgttggtatagaaatgccattgatttttgtatgttgattttgtatcctccaactttactgaatttattagttctaacagttttttgatggagtctttagggttttctatgtataagattatgtcatctgcaaacagcaacaattttaccctttgttttcaacgtgagcgtcttttatttatttttcttgcctaattgctttagctaggacttccagcactaaattgaatagaagtgatgagagtgggcatgtatgccttgtttctggtcttaaagaaaaacatttcagttttccattattcggtataatgttagttatgggtttttaaaaatatatatgacctttattaggttgaggtacttttcctctattcttagtttattgaatgtttttctcatgaaagtgtgttaaattttgtcaaaaccttttttacatccatcaaatgattatgtaatttttatcctttattctgttaatggattatcacattaactaattttcatatcttgaagcatacttgcatcctaggaataaatcccactttgtcatagtctttgatccttttaatataatgttaaatttggtttgccagtattttgttgaggatttttgcatctatatattcatcaaggatattgggctgtaattttcttttcttgtggtgtctttgtccggctttagtataaaggtaattctggcttcataaaataagttagaaagtgttctctcttctttgatttttttggaagagtttgagaataattggcattagttttgttaaatgtttggttgaattcactagtgaaattatttggtcctgggattttctttactgggagttttttgattacttgttcaatctttacgctagtcataggtctgtccagtctttgtatttcttcatgatttagtcatcatgtattcatgggttgtaagacttaatattcttaaaatgcccatattacccaaagtgatctatagattcatgcaatccccatcaaaaatcccagtggcatttttatttacagaaatagaataattctaaaattcatctgaagccacaaaagacaatgaataaacaaatcaatcttgaaaaagaagaacaaagctggaggcattatacttcctgatttcaaaatatcctgcaaaggtacagtaatcaaaacagtatgttaccagcataaagacaaacacacagaccaatagaacagaatagagagctcagcaacaaatccgtgaatatacagtcaactgacatttggcaatggtgccaagcatactcagtgggagaaatgataatctcttcaacaaatggtgttgggaaaactgaatatccacatgcaaaagaataaaattggaccctatcttataccaaaaatcaactcaaaatggattatttaaatgtaagacttgaaacagtaaaactcctagaagtaaacagaagagaaagtttcatgacattgcccttggcaatgatttcatgtacataacaacaaaagcacaggtaataaaaacaaaaatagacaaatgggactacctcaaattaaaatgtttctgcacagcaaacgaccaactgaatgaaaaggcaatctatggaacagaagacacggggtgacatgagaccactttggcaaatcagaatgctcattccatttggccaccatgattggttttagaaatggacttgaagctcaaagaaagcccataatatattccttaagatttgaatatagaggctggaagaaagatttttttctttctctaggatgacaagttatatataataagcctgtaggccaatatctgctggcagccacctttcccaggtatatggatgaaactatctgaaggatgaagcctccattcacagaaaatcagagctgtaaagggaagaggatatcctgatgaatttttttcttggattgagccatgtctgaagtcaagccaacttttgaagtatcctatagtacttatatattgcttggtaacaaattatgccaaaatttagtagcttaaaacaacaaacatctattatctcatgcatttctgatatagatataggagtgactaatctgggtggttctgggtcagaatctctggtgagtgtgtaggcaaggtgtcagtagggggctgcaattatctaaaggcttgcctggggctggagacgcactttcaatgtggtgtactcacgtggctgttggttggaggccaaatgtgctaggcaaagcctcatgcacatttctctgtaaggaaacaaagctggcttacttgggggcaggatttttttttttcccagttgttcttcaaaatgaagtttcccgctccaagtcccagccagatatgtgaaaaacaatccttgcagaacaaccctattagcagttctgcaaggatttttaggaaccgtattagcaagttcctcagttcctcaccatgtgaacctctcttcacgacttagtaactggcttcctctagagtgactaatccaagagacagcaaggattgacagccatgacagcacagtgcctttcatgacttactctccaaagttacaaacctttacttttgctttatcttatttgttagagcaagtcactaaatttgcccacatctaagatgagggtatttgggcttcacctcttgaatggagaagcacccaaaaatctgtggcctttttttttaattacactctcagttacatgaatcaataaattccatttttggcttagcttctattgggtttctatcacttgcaaccaaagtgccctaaccagtatctacatctgagtcattaagaaagtttcagacagggctgggcgcggtggctcacacctgttaatcccagactttgggaggccgaggcaggcggatcacgtggtcaggagatcgagaccatcctggctaacacggtgaaaccttatctctactaaaaatacaaaaaattagccgggtgtggtggcaggtgcctgaagtcccagctactcgggaggctgaggcaggggaatggcgtgaacccgggagacggagcttgcagtgagccgagatcacgccactgcgctccagcctgggcgacagagtgagactcagcttcaaaaaaaaaaaaaaaaaagaaagtttcagatattattgtttattgcttttaatctagtgaattcataaatcgtcacttaactcaagcaaaacaatgttactctctttgtacattgtacagatgcaggataacaatgcagtgttatcctgcatctgtacaatcaagcacccaaactggttctgtagaggcaggaccttagcatatagcagagataacttatcttccagcagatccggagctccattttgtagacagaaatgaatgctctgtgccacagaaggagctgttgcactattcattcccgtttcctcccattcactctccacatctccaatcctggcattgtctgctttgttacttgttaaaaacttgatttcgtagattgctttaaaataagaacaaaatgtactttgacacacatcattttgtttggttctcattaattttgagagaaaggcaagatagatatttaaatgacccctattttagtggtaaacaagctgaaattagataaataaaatgatttgcctaatg

SEQ ID NO: 362 - DNA, 2710 bp, Homo sapiens
aggagatgtgccaaactgttaagagtggttatttctgagcagaagaatgtggatgaattccattcttcctatttttcttttcaggtctgtgcggctgctaaagaacgacccagtcaacttgcagaaattctcttacactagtgaggatgaggcctggaagacgtacctagaaaacccgttgacagctgccacaaaggccatgatgagagtcaatggagatgatgacagtgttgcggccttgagcttcctctatgattactacatgggtcccaaggagaagcggatattgtcctccagcactgggggcaggaatgaccaaggaaagaggtactaccatggcatggaatatgagacggacctcactccccttgaaagccccacacacctcatgaaattcctgacagagaacgtgtctggaaccccagagtacccagatttgctcaagaagaataacctgatgagcttggagggggccttgcccacccctggcaaggcagctcccctccctgcaggccccagcaagctggaggccggctctgtggacagctacctgttacccaccactgatatgtatgataatggctccctcaactccttgtttgagagcattcatggggtgccgcccacacagcgctggcagccagacagcaccttcaaagatgacccacaggagtcgatgctcttcccagatatcctgaaaacctccccggaacccccatgtccagaggactaccccagcctcaaaagtgactttgaatacaccctgggctcccccaaagccatccacatcaagtcaggcgagtcacccatggcctacctcaacaaaggccagttctaccccgtcaccctgcggaccccagcaggtggcaaaggccttgccttgtcctccaacaaagtcaagagtgtggtgatggttgtcttcgacaatgagaaggtcccagtagagcagctgcgcttctggaagcactggcattcccggcaacccactgccaagcagcgggtcattgacgtggctgactgcaaagaaaacttcaacactgtggagcacattgaggaggtggcctataatgcactgtcctttgtgtggaacgtgaatgaagaggccaaggtgttcatcggcgtaaactgtctgagcacagacttttcctcacaaaagggggtgaagggtgtccccctgaacctgcagattgacacctatgactgtggcttgggcactgagcgcctggtacaccgtgctgtctgccagatcaagatcttctgtgacaagggagctgagaggaagatgcgcgatgacgagcggaagcagttccggaggaaggtcaagtgccctgactccagcaacagtggcgtcaagggctgcctgctgtcgggcttcaggggcaatgagacgacctaccttcggccagagactgacctggagacgccacccgtgctgttcatccccaatgtgcacttctccagcctgcagcgctctggaggggcagccccctcggcaggacccagcagctccaacaggctgcctctgaagcgtacctgctcgcccttcactgaggagtttgagcctctgccctccaagcaggccaaggaaggcgaccttcagagagttctgctgtatgtgcggagggagactgaggaggtgtttgacgcgctcatgttgaagaccccagacctgaaggggctgaggaatgcgatctctgagaagtatgggttccctgaagagaacatttacaaagtctacaagaaatgcaagcgaggaatcttagtcaacatggacaacaacatcattcagcattacagcaaccacgtcgccttcctgctggacatgggggagctggacggcaaaattcagatcatccttaaggagctgtaaggcctctcgagcatccaaaccctcacgacctgcaaggggccagcagggacgtggccccacgccacacacaacctctccacatgcctcagcgctgttacttgaatgccttccctgagggaagaggcccttgagtcacagacccacagacgtcagggccagggagagacctagggggtcccctggcctggatccccatggtatgcttgaatctgctccctgaacttcctgccagtgcctccccgtaccccaaaacaatgtcaccatggttaccacctacccagaagactgttccctcctcccaagacccttgtctgcagtggtgctcctgcaggctgcccgttaagatggtggcggcacacgctccctcccgcagcaccacgccagctggtgcggcccccactctctgtcttccttcaacttcagacaaaggatttctcaacctttggtcagttaacttgaaaactcttgattttcagtgcaaatgacttttaaaagacactatattggagtctctttctcagacttcctcagcgcaggatgtaaatagcactaacgatcgactggaacaaagtgaccgctgtgtaaaactactgccttgccactcactgttgtatacatttcttatttacgattttcatttgttatatatatatataaatatactgtatatatatgcaacattttatatttttcatggatatgtttttatcatttcaaaaaatgtgtatttcacatttcttggactttttttagctgttattcagtgatgcattttgtatactcacgtggtatttagtaataaaaatctatctatgtattacgtcacattaaaaaaaaaaa

SEQ ID NO: 363 - DNA, 1929 bp, Homo sapiens
agaacaattcaggcttcgctgcgactcagacctcagctccaacatatgcattctgaagaaagatggctgagatggacagaatgctttattttggaaagaaacaatgttctaggtcaaactgagtctaccaaatgcagactttcacaatggttctagaagaaatctggacaagtcttttcatgtggtttttctacgcattgattccatgtttgctcacagatgaagtggccattctgcctgcccctcagaacctctctgtactctcaaccaacatgaagcatctcttgatgtggagcccagtgatcgcgcctggagaaacagtgtactattctgtcgaataccagggggagtacgagagcctgtacacgagccacatctggatccccagcagctggtgctcactcactgaaggtcctgagtgtgatgtcactgatgacatcacggccactgtgccatacaaccttcgtgtcagggccacattgggctcacagacctcagcctggagcatcctgaagcatccctttaatagaaactcaaccatccttacccgacctgggatggagatcaccaaagatggcttccacctggttattgagctggaggacctggggccccagtttgagttccttgtggcctactggaggagggagcctggtgccgaggaacatgtcaaaatggtgaggagtgggggtattccagtgcacctagaaaccatggagccaggggctgcatactgtgtgaaggcccagacattcgtgaaggccattgggaggtacagcgccttcagccagacagaatgtgtggaggtgcaaggagaggccattcccctggtactggccctgtttgcctttgttggcttcatgctgatccttgtggtcgtgccactgttcgtctggaaaatgggccggctgctccagtactcctgttgccccgtggtggtcctcccagacaccttgaaaataaccaattcaccccagaagttaatcagctgcagaagggaggaggtggatgcctgtgccacggctgtgatgtctcctgaggaactcctcagggcctggatctcataggtttgcggaagggcccaggtgaagccgagaacctggtctgcatgacatggaaaccatgaggggacaagttgtgtttctgttttccgccacggacaagggatgagagaagtaggaagagcctgttgtctacaagtctagaagcaaccatcagaggcagggtggtttgtctaacagaacactgactgaggcttaggggatgtgacctctagactgggggctgccacttgctggctgagcaaccctgggaaaagtgacttcatcccttcggtcctaagttttctcatctgtaatgggggaattacctacacacctgctaaacacacacacacagagtctctctctatatatacacacgtacacataaatacacccagcacttgcaaggctagagggaaactggtgacactctacagtctgactgattcagtgtttctggagagcaggacataaatgtatgatgagaatgatcaaggactctacacactgggtggcttggagagcccactttcccagaataatccttgagagaaaaggaatcatgggagcaatggtgttgagttcacttcaagcccaatgccggtgcagaggggaatggcttagcgagctctacagtaggtgacctggaggaaggtcacagccacactgaaaatgggatgtgcatgaacacggaggatccatgaactactgtaaagtgttgacagtgtgtgcacactgcagacagcaggtgaaatgtatgtgtgcaatgcgacgagaatgcagaagtcagtaacatgtgcatgtttgttgtgctccttttttctgttggtaaagtacagaattcagcaaataaaaagggccaccctggccaaaagcggtctttaaa

SEQ ID NO: 364 - DNA, 2308 bp, Homo sapiens
agtcctgcttctcttccctctctcctccagcctctcacactctcctcagctctctcatctcctggaaccatggccagcacatccaccaccatcaggagccacagcagcagccgccggggtttcagtgccaactcagccaggctccctggggtcagccgctctggcttcagcagcgtctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggctgaggagcgtgaacagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaagaaggatgtggatgctgcctacatgaacaaggttgaactgcaagccaaggcagacactctcacagacgagatcaacttcctgagagccttgtatgatgcagagctgtcccagatgcagacccacatctcagacacatctgtggtgctgtccatggacaacaaccgcaacctggacctggacagcatcatcgctgaggtcaaggcccaatatgaggagattgctcagagaagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccacgtcaagaagcagtgcgccaacctgcaggccgccattgctgatgctgagcagcgtggggagatggccctcaaggatgccaagaacaagctggaagggctggaggatgccctgcagaaggccaagcaggacctggcccggctgctgaaggagtaccaggagctgatgaatgtcaagctggccctggacgtggagatcgccacctaccgcaagctgctggagggtgaggagtgcaggctgaatggcgaaggcgttggacaagtcaacatctctgtggtgcagtccaccgtctccagtggctatggcggtgccagtggtgtcggcagtggcttaggcctgggtggaggaagcagctactcctatggcagtggtcttggcgttggaggtggcttcagttccagcagtggcagagccattgggggtggcctcagctctgttggaggcggcagttccaccatcaagtacaccaccacctcctcctccagcaggaagagctataagcactaaagtgcgtctgctagctctcggtcccacagtcctcaggcccctctctggctgcagagccctctcctcaggttgcctttcctctcctggcctccagtctcccctgctgtcccaggtagagctgggtatggatgcttagtgccctcacttcttctctctctctctataccatctgagcacccattgctcaccatcagatcaacctctgattttacatcatgatgtaatcaccactggagcttcactgttactaaattattaatttcttgcctccagtgttctatctctgaggctgagcattataagaaaatgacctctgctccttttcattgcagaaaattgccaggggcttatttcagaacaacttccacttactttccactggctctcaaactctctaacttataagtgttgtgaacccccacccaggcagtatccatgaaagcacaagtgactagtcctatgatgtacaaagcctgtatctctgtgatgatttctgtgctcttcgctgtttgcaattgctaaataaagcagatttataatacaa

SEQ ID NO: 365 - DNA, 2302 bp, Homo sapiens
gtcctgcttctcctccctctcgcctccagcctctcacactctcctaagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggcgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggtcgtctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactcttacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatatgaggagattgctcagaggagcagggctgaggctgagtcctggtaccagacaaagtacgaggagctgcagatcacagcaggcagacatggggacgacctgcgcaacaccaagcaggagattgctgagatcaaccgcatgatccagaggctgagatctgagatcgaccacgtcaagaagcagtgtgccaacctacaggccgccattgctgatgctgagcagcgtggggagatggccctcaaggatgctaagaacaagctggaagggctggaggatgccctgcagaaggccaagcaggacctggcccggctgctgaaggagtaccaggagctgatgaacgtcaagctggccctggatgtggagatcgccacctaccgcaagctgctggagggcgaggagtgcaggctgaatggcgaaggcgttggacaagtcaacatctctgtagtgcagtccaccgtctccagtggctatggcggtgccagcggtgtcggcagtggcttaggcctgggtggaggaagcagctactcctatggcagtggtcttggcgttggaggcggctttagttccagcagcggcagagccactgggggtggcctcagctctgttggaggcggcagttccaccatcaagtacaccaccacctcctcctccagcaggaagagctacaagcactgaagtgctgccgccagctctcagtcccacagctctcaggcccctctctggcagcagagccctctcctcaggttgcttgtcctcccctggcctccagtctcccctgccctcccgggtagagctgggatgccctcacttttcttctcatcaatacctgttccactgagctcctgttgcttaccatcaagtcaacagttatcagcactcagacatgcgaatgtcctttttagttcccgtattattacaggtatctgagtctgccataattctgagaagaaaatgacctatatccccataagaactgaaactcagtctaggtccagctgcagatgaggagtcctctctttaattgctaaccatcctgcccattatagctacactcaggagttctcatctgacaagtcagttgtcctgatcttctcttgcagtgtccctgaatggcaagtgatgtaccttctgatgcagtctgcattcctgcactgctttctctgctctctttgccttcttttgttctgttgaataaagcatattgagaatgtgaa

SEQ ID NO: 366 - DNA, 2309 bp, Homo sapiens
gtcctgcttctcctgcctctcgcctccagcctccaacgctcgccacagccctctcatctcctggaaccatggccagcacatccaccaccatcaggagccacagcagcagccgccggggtttcagtgccaactcagccaggctccctggggtcagccgctctggcttcagcagcatctccgtgtcccgctccaggggcagtggtggcctgggtggtgcatgtggaggagctggctttggcagccgcagtctgtatggcctggggggctccaagaggatctccattggagggggcagctgtgccatcagtggcggctatggcagcagagccggaggcagctatggctttggtggcgccgggagtggatttggtttcggtggtggagccggcattggctttggtctgggtggtggagccggccttgctggtggctttgggggccctggcttccctgtgtgcccccctggaggcatccaagaggtcaccgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacagcatcgtcggggaacggggccgcctggactcggagctgagaaacatgcaggacctggtggaggacctcaagaacaaatatgaggatgaaatcaacaagcgcacagcagcagagaatgaatttgtgactctgaagaaggatgtggatgctgcctacatgaacaaggttgaactgcaagccaaggcagacactctcacagatgagatcaacttcctgagagccttgtatgatgcagagctgtcccagatgcagacccacatctcagacacatccgtggtgctatccatggacaacaaccgcaacctggacctggacagcatcatcgctgaggtcaaggcccaatacgaggagattgctcagaggagccgggctgaggctgagtcctggtaccagaccaagtacgaggagctgcaggtcacagcaggcagacatggggacgacctgcgcaacaccaagcaggagattgctgagatcaaccgcatgatccagaggctgagatctgagatcgaccatgtcaagaagcagtgtgccagcctgcaggctgccattgctgatgctgagcagcgtggggagatggcactcaaggatgctaagaacaagctggaagggctggaggatgccctgcagaaggccaagcaggacctggcccggctgctgaaggagtaccaggagctgatgaatgtcaagctggccctggatgtggagatcgccacctaccgcaagctgctggagggcgaggagtgcaggctgaatggcgaaggcgttggacaagtcaacgtctctgtagtacagtccaccatctccagtggctatggcggtgccagcggtgtcggcagtggcttaggcctgggtggaggaagcagctactcctatggcagtggtcttggcattggaggtggcttcagttccagcagtggcagagccattgggggtggcctcagctctgttggaggcggcagttccaccatcaagtacaccaccacctcctcctccagcaggaagagctacaagcactaaagtgctgcctccagctctcggtcccacagtcctcaggcccttctctggctgcagagccgtctcctcaggttgcctatcctctcctggcctctagtcttccctgctctccgaggtagagctgggtatggatgcttagtgccctcacttctctctgtctatacctgccccatctgagcacccattgctcaccatcagatcaacctttgattttacatcataatgtattcaccaatggagcttcactttgttactaaattattaatttcttgcctccaaaattgttctctctgaggctgagcattataagaaaatgatctctgttccttttcattactgaaaatcgcctggggcttatttcagaacaacttccacttattttccattggcccccaaactccctaagttaaaagtattgtgaacccccgccccgcagtatgcatggaagcacaagtgactagtcgtatgatgtacacagtctttctccctgtgatgatttctctgctctttgctctttgtaatttctaaataaagcaggttttagaataa

SEQ ID NO: 367 - DNA, 3927 bp, Homo sapiens
gtccactagccctgggcttcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagtcccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 368 - DNA, 1038 bp, Homo sapiens
agagagaaggcagggctgaaatacggtgtggccatggcacaggctccttcccacagcttggctcagcaggatggttagatttcccacgcgtcaaaagaatgctgaggaaggccttcacaatgaacagaaagctgcagtttcctcctctgtattctttctccactcccactcgcctcatgtaccccactgacccaggtatgagaaacccagcctgcaccttctatagcaccacatgcctagactgaggaaagatccacaaatgccactcttcttcgaatagcctaccttcatgaagtctcaccaacccgctgaatatggactccaacggtgccctaggggatggtggagccaccagatggaaggagcctggtgatcccgagaaggagagatgcctcgctgacctgaacatctttccagaactgttaaatgaagcctgcaggacaccagctgacagtggaaggactgaggaaggttgtataattttgtgcaaggtccaccacaaatccagctgaagaactgctccaaagtttaggtcatggcaagaacaagactggatcactccatgtcagtggaaacatgtccaccaacttcatcattgtctgttgtcatggttcactttagatgtaaacttgactggattaaggattccctaaagtgtcaggcctctgagcccaagctaagccatcatatcccctgtgacctgcatgtacacatccagatggccggttcctgccttaactgacgacattccaccacaaaagaagtgaaaatggcctgttcctgccttaactgatgacattatcttgtgaaattccttctcctggctcatcctggctccaaagctcccccactgagcaccttgtgacccccactcctgcccaccagagaacaaccccctttgactgtaattttcctttaccttcccaaatcttataaaatggccccaccccatctccctttgctgactttcttttcagactcagccctcctgcaaccagttgattaaaagctttattgctcacaaaaaaaaaaaaaaaa

SEQ ID NO: 369 - DNA, 6008 bp, Homo sapiens
gccggctctcactgtggcttgtggctccgggaaatggaacccagcttgggacagggatgggaatggatttgacttgtccttttggcatctccccagcctgtggagcccaggcctcttggagcatctttggggctgacgcagcggaggttccgggcacacgtggccactcccagcaggaggctgccatgccccacattcccgaggacgaggagccccccggagagccacaggcagcccagagccctgccggccaaggtcctcctgccgcaggagtatcttgcagtccaactcccacgattgtcctgactggggatgccacttcaccagaaggagaaaccgacaaaaacctggccaacagagttcacagtccccacaagaggctttctcaccgacacttgaaggtgtccactgcctccctgacatctgtggaccccgcggggcacatcattgacctggtgaatgaccagctgccagacatcagcatctcagaggaggacaagaagaaaaacctggcgctgctggaagaagccaagttggtgagtgagcgattcctgacccgccgtgggaggaagtccaggagcagccccggagactccccatcagctgtttccccgaacctcagccccagcgcttctcctacatcctctcggagcaactcacttacagtccccaccccgccaggtttggatgtgtgcagtggcccgccatcccctctgcctggagcaccaccacagcagaagggggatgaggccgacgtctcttcacctcaccctggcgagcctaacgtccccaaagggctagctgacaggaagcagaatgaccagaggaaagtgtctcagggcaggctggctcctcgtcctcctccagttgagaagtccaaagagattgcaatagaacaaaaggaaaacttcgatcccctccagtaccccgagaccacacccaaaggcctagctcctgttacaaacagcagtgggaaaatggccctgaacagccctcagcctggccccgtggagagcgagctggggaagcagctcttgaaaacgggctgggagggcagccctctgccgagaagtccaacccaggatgcggcaggagtgggtcccccagcctcccaggggagaggcccagctggagagccgatggggcccgaggctggctccaaagctgagcttccacccactgtgtcccggcccccgctgctgcgagggctctcctgggacagtggccctgaagaacctggcccccggctgcagaaagtgcttgccaagctgccactggcagaggaagaaaagcgttttgcaggcaaggccggcggcaagctggccaaggcccctggtctcaaagactttcagatacaagtgcagcccgtgcggatgcagaaactgaccaagctccgagaggagcacatcctgatgagaaatcagaacttagtggggctcaagcttccagaccttagtgaagcagctgagcaggaaaaagggcttccttctgaactctccccagctattgaggaagaagagtcaaagagtggcttagatgtcatgcctaatatttctgatgtgctgctgcgcaaactgcgggtccacaggagtctccctggaagtgcccctccactcactgaaaaggaagttgagaacgtgtttgtgcaactgtccttggcctttagaaatgacagctacactctggaatctagaattaaccaggctgaaagggaacgcaacctgacagaggagaacactgagaaagaactggaaaacttcaaagcttccattacgtcctcagcttcactctggcaccactgtgagcaccgggaaacctaccagaagttgctggaggacatcgctgtcctgcaccgcctggctgcccgcctctccagccgagctgaggtggtaggcgccgtccgccaggaaaagcgcatgtcgaaagcaacggaagtgatgatgcagtatgtggagaatctaaagaggacgtatgagaaggaccatgcggagctcatggagtttaaaaagcttgcaaatcagaattcaagccgcagctgtggcccctctgaagatggggtccctcgcacggcacggtccatgtccctcacgctgggaaagaatatgcctcgccggagggtcagcgttgctgtggttcctaagtttaatgccctgaatctgcctggccaaactcccagctcatcatccattccctccttaccagccttgtcggaatcacccaatgggaaaggcagcctacctgtcacttcagcactgcctgcacttttggaaaatggaaagacaaatggggacccagattgtgaagcctctgctcctgcgctgaccctgagctgcctggaggagcttagtcaggagaccaaggccaggatggaggaagaagcctacagcaagggattccaagaaggtctaaagaagaccaaagaacttcaagacctgaaggaggaggaggaagaacagaagagtgagagtcctgaggaacctgaagaggtagaagaaactgaggaagaggaaaagggcccaagaagcagcaaacttgaagaattggtccatttcttacaagtcatgtatcccaaactgtgtcagcactggcaagtgatctggatgatggctgcagtgatgctggtcttgactgttgtgctggggctctacaattcctataactcttgtgcagagcaggctgatgggccccttggaagatccacttgctcggcagcccagagggactcctggtggagctcaggactccagcatgagcagcctacagagcagtaggaaacctcacacctagccagtgccctgctctgagacactcagactaccaccctttccccaagtataacgtcaggcccaagtgtggacacactgccgcccatcccatcaggtcatgaggaagggttcttttaacactcggcacttctgtgggagctattcatacacagtgacttgatgttcttggaggatcaacaaaactgccctgggaaagcatccagtggatgaagaagtcaccttcaccaaggaactctattggaagggaaggtctcctgcccctagctcaggtggctggggagaactaaaacaccttcactggtggttgggggtaaggagcggggcacgggggaggaggaggtagggggcagtaaaaaacttactctcttttttcctctctgtaattggttatcaggaagaatttgcttaatgactaacaccctaagcatcagacctggaatttggagttgcaaagtgactatcttcccatttcccatctcattttcaataacttcagcctcccattctttcctttggaatgagagtttctttttacagaagtaggaaaggcttctcagaaaaaaaaaaaaaagtataggctgaatttagctcagtgcttgaaatgggaagatatgaattattatatacgcatctgtccacacatacacacatactgttgtgtacacacacacaacatgcctgtgcacagagccaacaacccttcaaaagtgtgctctgggtgtgtacctctggataaataagatgcatgccaagccaacccacagattttcaccagtgtggggcagtcaccaggcacctgttcaatgagctgtccacatggattgaagatgttttaaaaacacagaaaactcatggcttcaatggcagacttactagtctccatttcaaatgccaactctgagctgctgtacagcacaatctattccctattctctctttgaaaacagttaacccacctcacaggtgaatgaggagagaagatgtgctttctgcttcagtctcttactctgtgtgtgaccacatgcaagagtaaacttgcacctcagtgcttcagttcaaatggggtttccaaccccagtataattaggggtgtttcagagcatccccagttatttagcacaacactgaaggagcacatcccctctccattttgacttctctccccacttttacagccactgccttcatcagttttgtagaggtttgatttccatgtgggttttgttgtcattgttttgcatttttgttttgttattgatattgtttgctttcattgctaaaactcatatacgacttactatgagccaagcactgttctcagtattacataggtatgaattcatttaagtcctgaagaaaaagaaaaaaaaatacgaagtggatattacccttcccattttcaaataaggaaactgaagcacaaaaagaacaagtaacttgacaaggacaccccggtagtaaatcatggggctggagctcaaccccagggtaggctggctccagagctgtgctctccttgactcttctgatggtctcctagctggaagcctcacatttcagtctcattcccccaagtggcccatcagctactccatctctggctccccaactaaacagtttctctcatagtgctggacctccactcactagttttttttccagctgttcttctcttttcttcaggtcactcttctcgaccgagtgcaaaaattatcccctccataccagctttgatgaccttccttccatactcctcaccagacacaacataataggtcacacactcctctgtgctttctggcacgttttaaacattattattattgacctttacctatagtataccatggcctatttatgtatccatctcccctagcatttttcctcaaagacaagaaccatgtcttacccatctcttgggtaagtgcctagcatggtggctgacgcttgggagggtgtcattaaatgttgctcaaaagaacaagcaaacatttaaggtggtggagagcagcctggggacagctgacatgctgcatgcttctcagtaccagcaccatcacaatgcaaaaagcaacatctttcttaacctcagcttattctgtttttcagtctactctgtgagagagcaggaatgagaccagactagcaacaccattgccaagctcaaggactgggctcaatgcagtcactccttcagagagaccccccaccccaagcatgccccactttaaaatagcatgtttattgaagggggcatcctttacagtagctagaaaatgactgaggcccaagccagggttgatcaaggatgtgccattaaggtaaagagttacagagcagggcagagggactctgggggcagaagtggatgatttgcccggcctcttccagggggtctggatacaactgaaggagctttagctacatgaggccctcagagccaaagacaggatgcaaatagagttctagagagtggccgtggaagcagaactccaggtggggaatgttcaatctctgcctcccttaaagcagggccaggctcagctggccccattgttcacttggtcacaagtttcctacctttgtttctggatgagtcaaaggccaggaaggcagttatggagagctcctgcacctccagctgccccacagaaaagcctgcaagagtacttccaggcacaggccctctcccaccctattccatttgtaagcaagggaggtcgaggaaaaggacatctccaaaagggagcataagaatagccatatatacaggggctgaaaaagtgctcatgagtccatcttttctggaaagcaaagaccagcctgaagcagtgggagctgctgcccaagcggtagtgaactggagagaaacaggccctggattttcagtgaggatgtggatctgaagagtcccccaaatgcctctgaagtctgacatctctgcttagccctaggagtctggttccctgccttcagttgcagagtgatgtgtttgtgtcattgttgatgtcacctcctaaaaagaccttcactttctggctgccacaaagccatatgtgttgctccccatatacagcctgacagagtaaatggagaggaagtgctggatttgtgtatcactggctatcagttcctcatgttgttaagcctcacacaggtgtgctagcattgaactgtagagtgtcacatacctgagtttgaaaataaaagcacatttccaaa

SEQ ID NO: 370 - DNA, 6659 bp, Homo sapiens
agagatcgcgagcgaggcaccagcctgcagccggcccccagcacatcctcagccgcacagacactcggcgaggtggaggtgagggcgggcgccagcgaactcggagaggggctcgctcactcccaggcgatcccagccgccaccgccgccgcaccagcagcagcaacagcagcagcagcttccttcctcagactcccctcgagaggctggccaagcgggtgtagccgttgggggaggctcccgccgggggaacccggcgaggacaagagcagggcggccgccttccactcgggctgtccggcggcggctgcctccgcccgtgtgtccgtcaagggtgccgcgggatgtgtgtcagtttacgcctctgagatcacacagctgcctgggggccgtgtgatgcccaaggcaagtcttggttttaattattattattatcattattgttacgcttggctttcgggaaatactcgtgatatttgtaggataaaggaaatgacactttgaggaactggagagaacatatatgcgttttgtttttaagaggaaaaccgtgttctcttcccggcttgttccctctttgctgatttcaggagctactctcctcctggtgaggtggaaattccagcaagaatagaggtgaagacaagccaccaggactcaggagggaaacgctgaccattagaaacctctgcataagacgttgtaaggaggaaaataaaagagagaaaaacacaaagatttaaacaagaaacctacgaacccagctctggaaagagccaccttctccaaaatggatatgtttcctctcacctgggttttcttagccctctacttttcaagacaccaagtgagaggccaaccagacccaccgtgcggaggtcgtttgaattccaaagatgctggctatatcacctctcccggttacccccaggactacccctcccaccagaactgcgagtggattgtttacgcccccgaacccaaccagaagattgtcctcaacttcaaccctcactttgaaatcgagaagcacgactgcaagtatgactttatcgagattcgggatggggacagtgaatccgcagacctcctgggcaaacactgtgggaacatcgccccgcccaccatcatctcctcgggctccatgctctacatcaagttcacctccgactacgcccggcagggggcaggcttctctctgcgctacgagatcttcaagacaggctctgaagattgctcaaaaaacttcacaagccccaacgggaccatcgaatctcctgggtttcctgagaagtatccacacaacttggactgcacctttaccatcctggccaaacccaagatggagatcatcctgcagttcctgatctttgacctggagcatgaccctttgcaggtgggagagggggactgcaagtacgattggctggacatctgggatggcattccacatgttggccccctgattggcaagtactgtgggaccaaaacaccctctgaacttcgttcatcgacggggatcctctccctgacctttcacacggacatggcggtggccaaggatggcttctctgcgcgttactacctggtccaccaagagccactagagaactttcagtgcaatgttcctctgggcatggagtctggccggattgctaatgaacagatcagtgcctcatctacctactctgatgggaggtggacccctcaacaaagccggctccatggtgatgacaatggctggacccccaacttggattccaacaaggagtatctccaggtggacctgcgctttttaaccatgctcacggccatcgcaacacagggagcgatttccagggaaacacagaatggctactatgtcaaatcctacaagctggaagtcagcactaatggagaggactggatggtgtaccggcatggcaaaaaccacaaggtatttcaagccaacaacgatgcaactgaggtggttctgaacaagctccacgctccactgctgacaaggtttgttagaatccgccctcagacctggcactcaggtatcgccctccggctggagctcttcggctgccgggtcacagatgctccctgctccaacatgctggggatgctctcaggcctcattgcagactcccagatctccgcctcttccacccaggaatacctctggagccccagtgcagcccgcctggttagcagccgctcgggctggttccctcgaatccctcaggcccagcccggtgaggagtggcttcaggtagatctgggaacacccaagacagtgaaaggtgtcatcatccagggagcccgcggaggagacagtatcactgctgtggaagccagagcatttgtgcgcaagttcaaagtctcctacagcctaaacggcaaggactgggaatacattcaggaccccaggacccagcagccaaagctgttcgaagggaacatgcactatgacacccctgacatccgaaggtttgaccccattccggcacagtatgtgcgggtatacccggagaggtggtcgccggcggggattgggatgcggctggaggtgctgggctgtgactggacagactccaagcccacggtagagacgctgggacccactgtgaagagcgaagagacaaccaccccctaccccaccgaagaggaggccacagagtgtggggagaactgcagctttgaggatgacaaagatttgcagctcccttcgggattcaattgcaacttcgatttcctcgaggagccctgtggttggatgtatgaccatgccaagtggctccggaccacctgggccagcagctccagcccaaacgaccggacgtttccagatgacaggaatttcttgcggctgcagagtgacagccagagagagggccagtatgcccggctcatcagcccccctgtccacctgccccgaagcccggtgtgcatggagttccagtaccaggccacgggcggccgcggggtggcgctgcaggtggtgcgggaagccagccaggagagcaagttgctgtgggtcatccgtgaggaccagggcggcgagtggaagcacgggcggatcatcctgcccagctacgacatggagtaccagattgtgttcgagggagtgatagggaaaggacgttccggagagattgccattgatgacattcggataagcactgatgtcccactggagaactgcatggaacccatctcggcttttgcaggtgagaattttaaagtggacatcccagaaatacatgagagagaaggatatgaagatgaaattgatgatgaatacgaggtggactggagcaattcttcttctgcaacctcagggtctggcgccccctcgaccgacaaagaaaagagctggctgtacaccctggatcccatcctcatcaccatcatcgccatgagctcactgggcgtcctcctgggggccacctgtgcaggcctcctgctctactgcacctgttcctactcgggcctgagctcccgaagctgcaccacactggagaactacaacttcgagctctacgatggccttaagcacaaggtcaagatgaaccaccaaaagtgctgctccgaggcatgacggattgcacctgaatcctatctgacgtttcattccagcaagaggggctggggaagattacatttttttttcctttggaaactgaatgccataatctcgatcaaaccgatccagaataccgaaggtatggacaggacagaaaagcgagtcgcaggaggaagggagatgcagccgcacaggggatgattaccctcctaggaccgcggtggctaagtcattgcaggaacggggctgtgttctctgctgggacaaaacaggagctcatctctttggggtcacagttctattttgtttgtgagtttgtattattattattattattattattattatattttatttctttggtctgtgagcaactcaaagaggcagaagaggagaatgacttttccagaatagaagtggagcagtgatcattattctccgctttctctttctaatcaacacttgaaaagcaaagtgtcttttcagcctttccatctttacaaataaaactcaaaaaagccgtccagcttatcccatcctctgattgtcttctgacttaagggatttactgtggtgtaggttctgccagccaaccctacaagctgccatttccagtcctagcatttaagtaggatgttgttgcctttaacttttcttatccaggggaaaattgccattttagggtcagcatgaacagctctttcttgtatgcgatttaaaacaaactggaaaggaaacttcacacgtcaaaatccatagaagcgcctggacgaggcttaaagtgctttgtgagtgaataggagccattcgctaattctagacccacagtgtctggtggtggggcttcccttgtggggcttctggtggtggttttgccttttcttttccctcctccatgttcttctaaaacatatacatatatacatacacacatacacatattcttcaggtctctaagcccctggaagcagcattgtgtgatattctcagaggcaggggaaaatagagggaaaaatagagactattggtatgttctccccatcagcgagttattgtaactggtcaccactggacgggaaggagaacagaggagagggaaagagaagcccaacctctgtgatcatatgagggccaaggctgagcagtgtagacagagaccctttgaaatgcatttgtctctcaaatagactagtaaacaccgacttctcctttgggttacaaacaccatttcaacctttcgggagagtcagagctaggatgtacaagaactgattctaaccagaagtccgcaagtactgtggacaagaatgcttaaccatgctgcttcagccttgagagacctaggttcttacacatatgcacacacgcatacacacatgcacgcacacacacatacacacatgcacgcacgcacgcatgcacaccaatttatgtttttattaagtgccttgaaaaaatgaagaaaaatgtattttccctttatgtaaaaattagtgaatatcttatgaattaaggcattcctctttccctaaccccgatggctccattcccaagtaccccaactcactgctgatcctattaaaggaatgagtcctgctacccgagtggtagtcatagccctagatgactctcaactactcttcaaagggaggcatcaggaatagaatgaaactgtgtgaaggataagattgttcgcatcaagatccaaatcttgatttcatattaacgcctaaggattgcctgtgtgctggaaatatatttgaaactcaaccagtatgcccagcctattgcatatcattgtcagaccatttttgctgctgtggtcacccacgatttcatttgtcttatacccaggtgaaaggggaagggtgaatgggactggctggttcctttaaatgttaacttatggaaatgctagttcaaatggtaatgtcacagtgttttgtatgcagagagcaagagttcaaccaacagctgtttattcatgtgtgtgtgtctttgctgctttgagttctctgtatctactgtgtatgtgaatggtcatgtgggactcagtggtggtgttgtgactttgacctagggtccgagtgtcacagctgatcttggcactcggcactcattggcacagtggtagttagaggtgaaaagtagagctgtcaagcccaagggcttagctttagggctcctcctgagttcggcccacagtagaagcaagattttaactagccccttttcctcttcaccctcccatgatgcgcagtgttcagaaagctggtaagtcctagggatttccagaagtagcctgcagaagaaggtaagtttgaaagccactccaggggtcctgatgctgtcatgctcagtgagccattttacagttctccaaagtctagccctgtttcggacctgcacttcacctctaagttatgtacaactcaacctgcatccctctaaaagtcctatatccatattcaccattggctaatttgaggccctgagtgggccttgaatgctaaaaagaagcagggtacgcagggctacatgtagataccacaccaaggctggaggctggtctgtcataagacagaaagaaagacgctgggcccaattttgacttggccaggggacaccttggtgtgtttgttatctttatctgtgggtaggctagctgacccatctccttgagtcattccctttgggaaaccccactgccagtattgatctcctttttgccttgtactgaatgacacattacctccacactctcccggactaggtggtcaacagggccacagggttgctttctgtctttggtggggcaggggagttgacagggatgagggtccaaggaataagcatgaatgacaagaaaacaagggaaagagttaacctgtcacatagcaggttaactttttcagggtttgcagttagaggtattcgaccattcactggctgagccagatcacgggaacttgagagcttttactgtgattcttcaatgtaaaaaataaacaacaatgtcaaactgtgtttatatgatttgtataaagcctttttaagattactatttaaataaacattataccagaga

SEQ ID NO: 371 - DNA, 2802 bp, Homo sapiens
aggacgccgcccggcgcggagtggctgccctgcgcggggacacttagagcccggtgggcgggaggaaggcggcatgccccagacggtgatcctcccgggccctgcgccctggggcttcaggctctcagggggcatagacttcaaccagcctttggtcatcaccaggattacaccaggaagcaaggcggcagctgccaacctgtgtcctggagatgtcatcctggctattgacggctttgggacagagtccatgactcatgctgatgcgcaggacaggattaaagcagcagctcaccagctgtgtctcaaaattgacaggggagaaactcacttatggtctccacaagtatctgaagatgggaaagcccatcctttcaaaatcaacttagaatcagaaccacaggacgggaactactttgaacacaagcataatattcggcccaaacctttcgtgatcccgggccgaagcagtggatgcagcactccctccgggattgactgtggcagtggacgcagcaccccttcttctgtcagtactgttagtaccatttgcccaggtgacttgaaagttgcggctaagctggcccctaacattcctttggaaatggaacttcctggtgtgaagattgtacatgctcagtttaatacacctatgcagttgtactcagatgacaatattatggaaacactccagggtcaggtttcaacagccctaggggaaacacctttgatgagcgagcccacagcctcggtgccccccgagtcggacgtgtaccggatgctccacgacaatcggaatgagcccacacagcctcgccagtcgggctccttcagagtgctccagggaatggtggacgatggctctgatgaccgtccggctggaacgcggagtgtgagagctccggtgacgaaagtccatggcggttcaggcggggcacagaggatgccgctctgtgacaaatgtgggagtggcatagtcggtgctgtggtgaaggcgcgggataagtaccggcaccctgagtgcttcgtgtgtgccgactgcaacctcaacctcaagcaaaagggctacttcttcatagaaggggagctgtactgcgaaacccacgcaagagcccgcacaaagcccccagagggctatgacacggtcactctgtatcccaaagcttaagtctctgcaggcgtggcacgcacgcacgcacccacccacgcgcacttacacgagaagacattcatggctttgggcagaaggattgtgcagattgtcaactccaaatctaaagtcaaggctttagacctttatcctattgtttattgaggaaaaggaatgggaggcaaatgcctgctatgtgaaaaaaacatacacttagctatgttttgcaactctttttggggctagcaataatgatatttaaagcaataattttttgtatgtcatactccacaatttacatgtatattacagccatcaaacacataaacatcaagatatttgaaggactctaattgtctttccttgacaagttgattttgcaattgtggtaaatagcaaataacaatcttgtattctaacataatctgcagttgtctgtatgtgttttaactattacagtgcatgttagggagaaattccctgaatttctttagttttgtattcaaacaattatgccactcgatgcaacaaacataataaatacataaaagatttaaaaaatacctaatgaagtggcattcattgaattcaaataaaatcaacatttcaatgagagaacccaatcatattttaacatgtacactaacaaatattttaagataaatgtggcttcttcaggttttataactcattactctttcttatgagcacaaaatttctgatgatagaagcgttgaaatttgctagttaaaggtagttcagtctctttcaaattaaaagtttcacttgcttcaacagagactctttcaatttaaatatctctttcagatcaatattcagtcaaattgaaggttcaaagtccatcactgctgtttcttaggctcaatggttcaccacctcctcctcttcccaagatggcatctccaggaagaaacaatttagacgacttcctaaggaaggcaggggctgctggtctcctggggtcctgcttgtatccactgttgaaatccttggtttcacttgtgatctgtggtctgttttcttgacatagttgaggccaggcaataataacacctccactaccacctccaaaactctcagctcagctttcctggagtcatggatcctctgtctgagacatgcactctgcctggccctggcgcaggcagcctaccttgcaggctctgcatggcgttaccttgcctctcacccagggtgcccatggcaatgctcctgacttgcatctctcacctactttccatgtcccccactggggacgtacaggaacttctgaaactgtcccctcaggttcaaaccatggggaaccagcagggtggggaccctcagaccctctgtctcaccaccttgtgtcacatggtcatctctaccacccctcaacccccacagctgctaacttctggcctgaaacaagtgttctcctcccataaggtcccaaatgggacacaagttttattgctctgggattcttccaaacttaactgactctgaccctgacctgttcaggattttgagaggagccaaaacacgtgcctggcccctgtaggcatttgacattgcaactcctgtgccaacacatgcattcactaacaaagctattaaaaaaataaaacagacttttgagatcaaagaaa

SEQ ID NO: 372 - DNA, 5587 bp, Homo sapiens
agtgctgcctgtcacacctgagccagcagtttgtgcaaccagaggagcgcaggcagggttccctgctggggcccgggctgcccagccatgctttgggcactctggccaaggtggctggcagacaagatgctgcccctcctgggggcagtgctgcttcagaagagagagaagaggggccctctgtggaggcactggcggcgggaaacctacccatactatgacctccaggtgaaggtgctgagggccacaaacatccggggcacagacctgctgtccaaagccgactgctatgtgcaactgtggctgcccacggcgtccccaagccctgcccagactaggatagtggccaactgcagtgaccccgagtggaatgagaccttccactaccagatccatggtgctgtgaagaacgtcctggagctcaccctctatgacaaggacatcctgggcagcgaccagctctctctgctcctgtttgacctgagaagcctcaagtgtggccaacctcacaaacacaccttcccactcaaccaccaggattcacaagagctgcaggtggaatttgttctggagaagagccaggtgcctgcatctgaagtcatcaccaacggggttctggtggctcacccctgtctgagaatccagggcacgctccggggagatgggacagccccacgggaagagtacggctctaggcagctccagctggcagtgcctggagcctacgagaagccacagctcttgcccctgcagcctcccacagagccaggcctcccacccacctttaccttccacgtgaacccagtgctgagctccaggctacacgtggagctgatggagctgctggcagctgtgcagagtggccccagcgcagagttggaggctcagaccagcaagctgggcgaggggggcatcctgctctcctctctgcccctaggccaggaggaacagtgttctgtggccctgggggagggccaggaggtggctctgagcatgaaggtggaaatgagctccggggacctagacctacgccttggctttgacctctctgacggggagcaggagtttctggacaggaggaagcaggtcgtgtccaaggccctgcagcaagtgctgggattgagtgaggctctggacagtggccaggtgcctgtagtggctgtgttgggttccgggggtggaacccgagccatgtcttctctgtacggcagcctggcagggttgcaggagctcggccttctagacactgtgacctacctgagtggggtctctgggtctacctggtgcatctccacactctacagggacccagcctggtcccaggtggccttgcagggccccattgagcgtgcccaggttcacgtctgcagcagtaagatgggagctttgtccacggagcggctacagtactacactcaggaactgggggtccgggagcgcagtggccacagcgtgtccctcatcgacctctggggcctccttgttgagtatctcctgtaccaggaggagaaccctgccaagctgtctgaccaacaggaggcggtccgccagggtcagaacccttaccccatttacaccagtgtcaacgtccgcaccaacttgagtggggaagattttgcagagtggtgcgagttcacgccctatgaggttggcttccccaagtacggggcttatgttcccaccgagctcttcggctcagaactcttcatgggacgattgctgcagctccagcctgaaccccggatctgttacctgcaaggtatgtggggcagcgcctttgccaccagcctggatgagatcttcctaaagaccgccggctcgggcctcagcttcctggagtggtacagaggcagtgtgaatatcacagacgactgccagaagcctcagctgcacaacccctcgaggctgcgaacgaggctcctcaccccacaggggcccttctcccaggctgtgctggacatattcacctcccgcttcacttccgcccagagctttaacttcacccggggtctctgcttgcacaaggactatgtggctggcagggagttcgtggcctggaaagacacacacccggacgccttccccaaccagctcacccccatgcgggactgcctgtacctggtggacggaggctttgccatcaactctccgttcccactggctctgctgcctcagagagcagtggacctcattctgtcctttgactattccttggaagccccttttgaggtcttgaagatgacagagaagtactgcctggaccgaggaatccccttccctagcatcgaggtgggccctgaggacatggaggaggcccgtgagtgctatctgtttgccaaggctgaggacccccgctcccccattgtgctgcacttccccctggttaaccgtaccttccgcacacacctggccccaggtgtggagcgacaaacagctgaggagaaggcctttggggactttgtcatcaacaggccagacaccccctatggcatgatgaacttcacctatgagccccaggacttttatcggctggtggccctcagtcgatacaacgtcctgaacaacgtggagaccttgaagtgcgccctccagctggctctggaccggcaccaggctcgggagagggcaggggcctgaccaaggcaggaagcggaggactgtgacagagaggagacacactgctcatggtcagggcttgtagagggaggagcgatggggactctgtgcaggatctgcttcccttctctccaggacctgcctcgaggtgccccaggccccggaaagctcttgcagaattgcagcttggactggggcagggctctccttgtgtgtttttggagaagatgggcagtagatcgctccagggactcttggggatgtagggcagaagagaacagcactcatttcacagcggggtgtggagagaatcaggtgagccacagagcccaccccagacacagaaggacctcagagggcccaagtcctcagacccacacagaacaggggctgagggcactgagaagccagctgtcctccttacactgagatggaaagcagagatgcatccatccacacttcctgcagagcggcccaagccccaaccccacctcgagctcctggatgcactgctatcaagaacaatgaggggctgaggggatggccagcctatgttgctgactccatcatcctaaccctccttctgccttctggtctcctcgtgcctcctcccagatcacccttctcttcccagcgccctaaagcctgtggggtgatgtcccattctggctgctccaggtgggagatgtgcgcgtgtctccctgccagttacccaggcttcactcttcgaacctggaccacagtctctggtgatgtgtgtagtggccacatcatgcaaatatagtctcaccattcctaggagctaaatgggtgtgtctagtaggggcatcagttcatcgggggagaggtgtgcacctgtatgtggggcaggagggtgtgcaagttcctggaggtgggttactccaaggcatgggcagtgcagagggagcctcgcctgggctcttgcctctttcccagatgcatccaatgggtcttggcaagttttgtttctcactctccctcttctccatttcccctgacccgccagggactctccaaatacctagaacctctctagtgtgggcagccctcagattcgtgaagaggagatcccgttctggccaggccctctccatctggccacggcctctgcagcatatgcctccagtgctgagctgcctaggagcctgcagcagcacttgagaccttgttccttctgccccctgtcccaggggctccctcttggctgcaccccctgctccatgctctctcacacagacacgctgtcaggaacacctgtgctgggaagccttacctgtcctgagtctggaaagaagactagttctggtttccaggttggggaagggtgactggagcccagcctgtgtcttggcctggcctgggatctgcagccctccagctggcatgagttgcgagggctgggggagccagttatttgggctggcatggggtggggacacctcagttctcctctgcctcctcaccatggctgcctgtcacaggccacggcccctccccttggttcagcagtgagaggtttatctgggagtttatctggctcctgctgtggccattgtcatcaacactgctgtgcctgccgtcatcaataacttgttagtaaaaccttcatagggttcacagctcagaactgcacagcgttcacaacttagaatctgtggtgtttcttcagtgcccattagagcctcaggctgtctctggctcctagaaagtcattctaccatctgttttgttcactgctgtatcctcagtgcctagagcagcagttgatacatggtaggtgctcagtaaatatttgataaatgaatgggaacctacattctaagaaatggatcgtcacccaccaaccacaaaaaagcatgcaatgctttcatgattcctaacccatgtggactttttgaagagctgatataaaccacagaccctctcccaagaaaaaggcatacacacacacatgaaaagttgcttacaataaggtctctgcttcagctatgtgatcagcagccccagggttgcagaggccagcgtctgtccccgcaggccagcaaggcttgtgaaggaggcaaacgtgggcttgtgcagagtgggcggggaccttctcacacagaagtgtaggcaatgccacttgtgctcagataaggtttgggaggagactgggacaagatcaagggcagggggcagggggcaggaggctgggctagtgctgtggcccagatattggccagaagtacagggaggatctcagccagggatggggaggctccaacaagactgaatctgggagccacgcagagcaagaagccaggggaggggccgaaggtaacccagccagtttaatgtctgctcctcaggagagatctgagtctttacctcattcccaacccttatctgagatggctggaaataagcttcagggtcctgaaggtgacagagttggagggatttgtctagaagagcaagcatggtttcccttgaagctgggtagaaacacaggagcagggacatcattcatcaacttgtcagagctcctcatgaggcaagggaagaaaaagggggccacaagtgtaggagattggtcagagtggtgggagaagctatagggaaaggagcaggccttctgaaaggttggaaggctctgcatagctttggaggagaatagctaaagacagctgttctataaccctgaggcagagggcaaggagtaggtacgagggagtgtgggggaatttatcttaaacaggcttgtttacttctgttgaccaggaactgacctttgatcatctacgcccatgaccttccctgaaaggggaacaataaatgttaattacctccagtgtttgctccaggcttttggcattgtgcctgcactgaataaaagcaagcagctccagcttctcagggctgcactttggccacttgagctgggcagtcccctagctgctcttacactgca

SEQ ID NO: 373 - DNA, 3002 bp, Homo sapiens
gacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacgctgaacctgcaaaacaaccgcctgacttcccgagggctcccagagaaggcgtttgagcatctgaccaacctcaattacctgtacttggccaataacaagctgaccttggcaccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccgcaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggtgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatcccta

SEQ ID NO: 374 - DNA, 3301 bp, Homo sapiens
gccagttctcttcggggactaactgcaacggagagactcaagatgattccctttttacccatgttttctctactattgctgcttattgttaaccctataaacgccaacaatcattatgacaagatcttggctcatagtcgtatcaggggtcgggaccaaggcccaaatgtctgtgcccttcaacagattttgggcaccaaaaagaaatacttcagcacttgtaagaactggtataaaaagtccatctgtggacagaaaacgactgtgttatatgaatgttgccctggttatatgagaatggaaggaatgaaaggctgcccagcagttttgcccattgaccatgtttatggcactctgggcatcgtgggagccaccacaacgcagcgctattctgacgcctcaaaactgagggaggagatcgagggaaagggatccttcacttactttgcaccgagtaatgaggcttgggacaacttggattctgatatccgtagaggtttggagagcaacgtgaatgttgaattactgaatgctttacatagtcacatgattaataagagaatgttgaccaaggacttaaaaaatggcatgattattccttcaatgtataacaatttggggcttttcattaaccattatcctaatggggttgtcactgttaattgtgctcgaatcatccatgggaaccagattgcaacaaatggtgttgtccatgtcattgaccgtgtgcttacacaaattggtacctcaattcaagacttcattgaagcagaagatgacctttcatcttttagagcagctgccatcacatcggacatattggaggcccttggaagagacggtcacttcacactctttgctcccaccaatgaggcttttgagaaacttccacgaggtgtcctagaaaggatcatgggagacaaagtggcttccgaagctcttatgaagtaccacatcttaaatactctccagtgttctgagtctattatgggaggagcagtctttgagacgctggaaggaaatacaattgagataggatgtgacggtgacagtataacagtaaatggaatcaaaatggtgaacaaaaaggatattgtgacaaataatggtgtgatccatttgattgatcaggtcctaattcctgattctgccaaacaagttattgagctggctggaaaacagcaaaccaccttcacggatcttgtggcccaattaggcttggcatctgctctgaggccagatggagaatacactttgctggcacctgtgaataatgcattttctgatgatactctcagcatggatcagcgcctccttaaattaattctgcagaatcacatattgaaagtaaaagttggccttaatgagctttacaacgggcaaatactggaaaccatcggaggcaaacagctcagagtcttcgtatatcgtacagctgtctgcattgaaaattcatgcatggagaaagggagtaagcaagggagaaacggtgcgattcacatattccgcgagatcatcaagccagcagagaaatccctccatgaaaagttaaaacaagataagcgctttagcaccttcctcagcctacttgaagctgcagacttgaaagagctcctgacacaacctggagactggacattatttgtgccaaccaatgatgcttttaagggaatgactagtgaagaaaaagaaattctgatacgggacaaaaatgctcttcaaaacatcattctttatcacctgacaccaggagttttcattggaaaaggatttgaacctggtgttactaacattttaaagaccacacaaggaagcaaaatctttctgaaagaagtaaatgatacacttctggtgaatgaattgaaatcaaaagaatctgacatcatgacaacaaatggtgtaattcatgttgtagataaactcctctatccagcagacacacctgttggaaatgatcaactgctggaaatacttaataaattaatcaaatacatccaaattaagtttgttcgtggtagcaccttcaaagaaatccccgtgactgtctatacaactaaaattataaccaaagttgtggaaccaaaaattaaagtgattgaaggcagtcttcagcctattatcaaaactgaaggacccacactaacaaaagtcaaaattgaaggtgaacctgaattcagactgattaaagaaggtgaaacaataactgaagtgatccatggagagccaattattaaaaaatacaccaaaatcattgatggagtgcctgtggaaataactgaaaaagagacacgagaagaacgaatcattacaggtcctgaaataaaatacactaggatttctactggaggtggagaaacagaagaaactctgaagaaattgttacaagaagaggtcaccaaggtcaccaaattcattgaaggtggtgatggtcatttatttgaagatgaagaaattaaaagactgcttcagggagacacacccgtgaggaagttgcaagccaacaaaaaagttcaaggatctagaagacgattaagggaaggtcgttctcagtgaaaatccaaaaaccagaaaaaaatgtttatacaaccctaagtcaataacctgaccttagaaaattgtgagagccaagttgacttcaggaactgaaacatcagcacaaagaagcaatcatcaaataattctgaacacaaatttaatatttttttttctgaatgagaaacatgagggaaattgtggagttagcctcctgtggtaaaggaattgaagaaaatataacaccttacaccctttttcatcttgacattaaaagttctggctaactttggaatccattagagaaaaatccttgtcaccagattcattacaattcaaatcgaagagttgtgaactgttatcccattgaaaagaccgagccttgtatgtatgttatggatacataaaatgcacgcaagccattatctctccatgggaagctaagttataaaaataggtgcttggtgtacaaaactttttatatcaaaaggctttgcacatttctatatgagtgggtttactggtaaattatgttattttttacaactaattttgtactctcagaatgtttgtcatatgcttcttgcaatgcatattttttaatctcaaacgtttcaataaaaccatttttcagatataaagagaattacttcaaattgagtaattcagaaaaactcaagatttaagttaaaaagtggtttggacttgggaacaggactttatacctcttttactgtaacaagtactcattaaaggaaattgaatgaaa

SEQ ID NO: 375 - DNA, 3458 bp, Homo sapiens
gccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaacttcagaaacgctgggcagtctgcctttcaaccatgcccctgtccctgggagccgagatgtgggggcctgaggcctggctgctgctgctgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtccttccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagccggaggagagtgtagggctgagagccgagggccaccctgatagtctcaaggacaacagtagctgctctgtgatgagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtctcactatgttgctcaggctggccttgaactcctgggctcaagcaatcctcctgcctcagcctccctagtagctgggactttaagtgtacaccactgtgcctgctttgaatcctttacgaagagaaaaaaaaaattaaagaaagcctttagatttatccaatgtttactactgggattgcttaaagtgaggcccctccaacaccagggggttaattcctgtgattgtgaaaggggctacttccaaggcatcttcatgcaggcagccccttgggagggcacctgagagctggtagagtctgaaattagggatgtgagcctcgtggttactgagtaaggtaaaattgcatccaccattgtttgtgataccttagggaattgcttggacctggtgacaagggctcctgttcaatagtggtgttggggagagagagagcagtgattatagaccgagagagtaggagttgaggtgaggtgaaggaggtgctgggggtgagaatgtcgcctttccccctgggttttggatcactaattcaaggctcttctggatgtttctctgggttggggctggagttcaatgaggtttatttttagctggcccacccagatacactcagccagaatacctagatttagtacccaaactcttcttagtctgaaatctgctggatttctggcctaagggagaggctcccatccttcgttccccagccagcctaggacttcgaatgtggagcctgaagatctaagatcctaacatgtacattttatgtaaatatgtgcatatttgtacataaaatgatattctgtttttaaataaacagacaaaacttg

SEQ ID NO: 376 - DNA, 3468 bp, Homo sapiens
attgtgccctaccagagaggacagatgggcaccgcctccagtggcaatgctaattcacccaagaggccttcccagctcttctcacagaaggaagataaactccacatatttctatatcctgctggatgacattgtccttacccattctctcttcctcccgacggagaaatttctgcaggagctacaccagtactttgttcgggcaggaggcatggagggccctgaagggctgggccggaagcaagcctgtctagccatgcttctccatttcttggacacctaccaggggctgcttcaagaggaagagggggccggccacatcatcaaggatctatacctgctaattatgaaggacgagtccctttaccagggcctccgagaggacactctgaggctgcaccagctggtggagacggtggaactaaagattccagaggagaaccagccacccagcaagcaggtgaagccactcttccgccacttccgccggatagactcctgtctgcagacccgggtggccttccggggctctgatgagatcttctgccgtgtatacatgcctgaccactcttatgtgaccatacgcagccgcctttcagcatctgtgcaggacattctgggctctgtgacggagaaacttcaatattcagaggagcccgcggggcgtgaggattccctcatcctggtagctgtgtcctcctctggagagaaggtccttctccagcccactgaggactgtgttttcaccgcactgggcatcaacagccacctgtttgcctgtactcgggacagctatgaggctctggtgcccctccccgaggagatccaggtctcccctggagacacagagatccaccgagtggagcctgaggacgttgccaaccacctaactgccttccactgggagctgttccgatgtgtgcatgagctggagttcgtggactacgtgttccacggggagcgcggccgccgggagacggccaacttggagctgctgctgcagcgctgcagcgaggtcacgcactgggtggccaccgaagtgctgctctgcgaggccccgggcaagcgcgcgcagctgctcaagaagttcatcaagatcgcggccctctgcaagcagaaccaggacctgctgtctttctacgccgtggtcatggggctggacaacgccgctgtcagccgccttcgactcacctgggagaagctgccagggaaattcaagaacttgtttcgcaaatttgagaacctgacggacccctgcaggaaccacaaaagctaccgagaagtgatctccaaaatgaagccccctgtgattcccttcgtgcctctgatcctcaaagacctgactttcctgcacgaagggagtaagacccttgtagatggtttggtgaacatcgagaagctgcattcagtggccgaaaaagtgaggacaatccgcaaataccggagccggcccctttgcctggacatggaggcatcccccaatcacctgcagaccaaggcctatgtgcgccagtttcaggtcatcgacaaccagaacctcctcttcgagctctcctacaagctggaggcaaacagtcagtgagagtggaggctccagtcagacccgccagatccttgggcacctggcactcaagcactttgcacgatgtctcaaccaacatctgacatctttcccgtggagcaacttcctgctccacgggaaagaggtcgatggatttacccctggacccataagtctgttcatcctgctgaagtcccctccccattgctccttcaagccaaaactacactttgctggttcctgtcccctctgagaaaggggatagaaagctccttcctctatgtcctcccatcgagatctgttctggggatggagcttccaacttcctcttgcagcaggaaagaatgctgctcacccttctgtcttgcagagtgggattgtgggagggattggcagccttcttctccaccacctgtccagcttcttcctggtcagggctgggacccccaggaatattatgttgccgtgtgtgtgtgtgtgtgtgtgtgtgtgtgtgtgtgtgtgtgtgtgtgtgtgtgtgtgtcttcttttagggagcaggagtgcatctggtaattgagggtggatgttgtgtgtgctggggaggggtccttctgtttggtgctacccttgtctactctgcccctggatggtgcggggtgctttctccacccccacactccctgctcagctcctcgtgctgccctgcatgcccaggcttgtgagccaagctgctttttggggcagggagtagcagcaggtgggaggggttacccatcagcccttgcaagtcccccactcaggcctctggaaggtccagggatgggctctgatgagagggtaaaagatgctcagggaaacacaggcctcagctgcctagaggaccctccccctgccttgcagtgggctcgggtagagcagtatcaggagctagggttgtctgctgcccacactcctgctttttgggatatctaactgctaaggagggagttgacatcccccttctggctcatgtgtctgacaccaacaacatggtctctgtccctctctctttgactctccctttgtcctccccatagagctggggtggggtggatccctatacctggggcaggcagccccaaagtgggggagggggatggcagagactgtaaaggcgccactggactctggcaaggcctttattacctttactcccctccctctcccatcaccagcctcaaggcctgaggggtgcaggggctcctggcagctactgggtgaggtttcctggcacagactcacccttctttctggcaccacctctttcccttttgaagagacagcaacagccgtagcaaaagcagctgctgctcctgctatgagggtgtatatattttttacccaaagctctggaattgtacatttattttttaaaactcaaagagggaaagagccttgtatcatatgtgaacattgtatcataggtaatgttgtacagacccttttatacagtgatctgtcttgttcctgcagcaaaaatcctctatggacataggaggtgctgtgtcccatgccctcttgccctgacagtgtcccatgggcccccttctgctccctgccccctccctgctactgctgatgcactctcctctccctgcagcccctggcttcccagccttcctcctgaccccttccaacagccttggaactccagctgccaccaccctctgggtcggacactgggacccactggcccagtcttggctgctgcttacccctagccttgatgcctgcccagggacccccagccccctcccgttgccctgcagctttaacagagtgaaccatgtgtattgtacaggcgcggttgtcattgcagaaaccgctgggtggagaagaagccgataaagtctatgaatcaacctgccaaaaaaaaaaaaaaaaaa

SEQ ID NO: 377 - DNA, 3965 bp, Homo sapiens
agagcgcttgggatccacggcgctcggaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagccggggggccgggggcgtgcggggggtgccgaggggcgcggcgtcaagtgcgtgctggtcggcgacggcgcggtgggcaagacgagcctggtggtgagctacaccaccaacggctaccccaccgagtacatccctactgccttcgacaacttctccgcggtggtgtctgtggatgggcggcccgtgagactccaactctgtgacactgccggacaggatgaatttgacaagctgaggcctctctgctacaccaacacagacatcttcctgctctgcttcagtgtcgtgagcccctcatccttccagaacgtcagtgagaaatgggtgccggagattcgatgccactgtcccaaagcccccatcatcctagttggaacgcagtcggatctcagagaagatgtcaaagtcctcattgagttggacaaatgcaaagaaaagccagtgcctgaagaggcggctaagctgtgcgccgaggaaatcaaagccgcctcctacatcgagtgttcagccttgactcaaaaaaacctcaaagaggtctttgatgcagccatcgtcgctggcattcaatactcggacactcagcaacagccaaagaagtctaaaagcaggactccagataaaatgaaaaacctctccaagtcctggtggaagaagtactgctgtttcgtatgatgctggcaagacacccagaaaggctattttcagatgaaatcgatattagaagctatattagctgaaacaactccttttactgcgtagaacctatatcgagagtgtgtgtatatgtattataggaggagctctcaattttatgtattctttctgcctttaattttcttgtttgtttgagcttagggatgagatacttatgcaagatatttttgaagtaaattaaacatttttcacatctctggaaatttagagttctagacctctggttaatttatatctaatatgaagaagacacctctaatctggatgttaagaatgaagttctgctacattataatgtacagaagagcaaaagggaggaacactatggttaaccctctcttgattaagggctacttaatgcacagtgcattatgtacacaggtcaaccatggtaacaatagttcttagctttgaaactccatgcaaaccatgccttttttttaaggagcaaaaatctgagaaaaaaagtgagagacctctgcctacaaaacctcaaaccagtcacttttgtcaattgctaatacccagttacttatgatttaaaaacaaccaacagaaaacatcccactgactgtatggcactctgtagtcaaaaaaggaaacttccttattgggacttttctttcttagtccagttgtgttgacacatatgaacacagacaaagtgctatgcggaggaaagcaagtgttggtcagtagtttcatgttttagggagtggttcctgtggagatcagaaagtgacatttgctttcggtactgtaatacgtgcaccaaactgcctcaatcctaggtaacgagggcaacagggagcacctgtctggattgtttttaaacctccatactcaagctgtctcttcggcagggaggtgaatactcttgaaaggccaacagcaagtgtttgtgggacacaacacagataattttttcttaagtcggccaagatgtacttctctgtgtgcacacccatgcacactcatgcacacagatacataggtctgtatggctgtatttgctgttgattcagactttcacaccattaatggggaaaagcgtggccacaaaaacagatgctaggaagcttggcttcctcttcttgttgacccttttttgaaccaacatcttttttattatattcagagtatgtttttaagtgtatcttaatatatacattttttaggacatcttaaatctaaacaaaaaataaaatgaacatctcttgaaacctgttaaaacaaccagttaaagccacagatggctttcagggcagtagcagcagaggccagtggactctgaggactcctgaggggcggggcgtgtagccagccaggtgcatgccgggaccatggcccccatacttggctgcttcctgtgacagtgaaatacatccttcaaggtggcagctgttagggctgaatcttctggagaaaaaggtgccatctcaggagaatagcttttactctggtaggaatgcttccgagacaccacaaggcagcctgaacactcagttgcagggtcgggcttgcggtgggtgacccagagccaccaaagtcacatccacaactaatgagggaaatctgtaaagccagttagatagaagaattttatttttctgtgggttttgtgttgtcttttttatgttaaaaagaaatccagtttgtgtttttctatagaaaaagtaaaagatcaggttatactttaggttaggggttctatttattcctgttagtaaataaaattaacaaatttctttgtttaacaaaagattaatctttaaaccactaaaatacatagactgattgattattcaacacattggaattgatgtcggtcatagtttcctgaagcatttagttacaacctgaaggaataaaatgatttgtggaaatgcttaaaatagacctaactgaatacagtctcatcttgccgcgcctggcttacctatctgtggaaagctaggcttcccaggctgggctctgcctgtctggtgcctggaggtgtgggagggaagatgagttatttaactggtaagcgatttgaaacactatttttatattaaagtaaatggcatggagtatagtgcaaattcatttttaagatagaacacaaaacttgaaagaagttttatgcgtgtgacagtgtatggggctgcagttggtctccctggaggggacttccacacctcctgcctttaggccatgggtggaaagtgctcagtgaagtacacctgtgtggcccagttctgaaagctttatacagttgaattttaagtggggttgataacaccttggactgttagtgttaaaaatctagtgggttgacctttaaatgcaacagtttttaaaatatattgctgcattttatagaatagtaaaggtacgattatacttgagattttcctccatttttatttcttcgtgaacatagagtttggggccgaaaatgtttttaaagtatgtgtttgagttaaatataaagttggttcacttcaaagctaaaaaattgttaaacttgcagcttggtattgcagagaagattttataagaattttgctttagagaatgccactttggctgaactacaagtgtaggccaccattataatttataaatacagcatacttcaaaactgtttgttatctcttgttaccatgtatgtataaatggaccttttataaccttgttctctgcttgacagactcaagagaaactacccaggtattacacaagccaaaatgggagcaaggccttctctccagactatcgtaacctggtgccttaccaagttgtgcttttctgttttcaagtgtaaatgatgttgagcagaatgttgtacttgaaaatgctataagtgagatggtatgaaataaattctgacttatgaa

SEQ ID NO: 378 - DNA, 1650 bp, Homo sapiens
acccattcagtcagaggcagccagcgggacctgcttcaccgagcgcagcgaagccgagacccgggctggcccctctgctgcccccggagcgggccatgccgccgcgggagctgagcgaggccgagccgcccccgctccgggccccgacccctcccccgcggcggcgtagcgcgcccccagagctgggcatcaagtgcgtgctggtgggcgacggcgccgtgggcaagagcagcctcatcgtcagctacacctgcaatgggtaccccgcgcgctaccggcccactgcgctggacaccttctctgtgcaagtcctggtggatggagctccggtgcgcattgagctctgggacacagcgggacaggaggattttgaccgacttcgttccctttgctacccggataccgatgtcttcctggcgtgcttcagcgtggtgcagcccagctcctttcaaaacatcacagagaaatggctgcccgagatccgcacgcacaacccccaggcgcctgtgctgctggtgggcacccaggccgacctgagggacgatgtcaacgtactaattcagctggaccaggggggccgggagggccccgtgccccaaccccaggctcagggtctggccgagaagatccgagcctgctgctaccttgagtgctcagccttgacgcagaagaacttgaaggaagtatttgactcggctattctcagtgccattgagcacaaagcccggctggagaagaaactgaatgccaaaggtgtgcgcaccctctcccgctgccgctggaagaagttcttctgcttcgtttgagcagctatggctgcatagcaagtagtaggcaggaggccaaagacttctgagacctggggcacccgggcctttgcggcagctactggcagggcctggccacctcataggactcagttcccttctgaacactcgggggacatgggcctctaactgcccactctgatatgcctgggtgagcctaggagggaaggctctgatttggatttctccagtcaaagctcacagaaaaaaacctggcactttgattttcatgggatggtcctaacagggtcagtcacctccgagcagtttgggaacccagtttcttgtcctgggccctcaggtcagcctggctgaattaggacccttccttggcacaggggtgagaaagagcttggggaacgcttggcattatggagggctggaaggggctcaaccccgatttggagagaagtttgggatggagtgggcgagagattgagagagcgagcaggaaaagaggtcttggagcctgggactgatggtggataaggcctggaaagaagatgacgaggaggaggagagagggaagtggggtggatgaggagcaggctgacacctgggctgccctcaatccccaaggccagggagggcggggctggcccctgggaagaactgggtctctgggctccctaggcactgcccaaactggctgagccaggagtggggcaggaagtgagagtcaaggcccagcaaaaggagggggaggagctgcaaattagaacctgaaggaggaccgggttggggatcatccctttcctcaaggtcacacagcctagaagctagagcagtgcagagtctgcaaataaaaccttaagtctgtgaa

SEQ ID NO: 379 - DNA, 3309 bp, Homo sapiens
ttcagcccctctcccgggctgcgcctccgcactccgggcccgggcagaagggggtgcgcctcggccccaccacccagggagcagccgagctgaaaggccgggaaccgcggcttgcggggaccacagctcccgaaagcgacgttcggccaccggaggagcgggagccaagcaggcggagctcggcgggagaggtgcgggccgaatccgagccgagcggagaggaatccggcagtagagagcggactccagccggcggaccctgcagccctcgcctgggacagcggcgcgctgggcaggcgcccaagagagcatcgagcagcggaacccgcgaagccggcccgcagccgcgacccgcgcagcctgccgctctcccgccgccggtccgggcagcatgaggcgcgcggcgctctggctctggctgtgcgcgctggcgctgagcctgcagccggccctgccgcaaattgtggctactaatttgccccctgaagatcaagatggctctggggatgactctgacaacttctccggctcaggtgcaggtgctttgcaagatatcaccttgtcacagcagaccccctccacttggaaggacacgcagctcctgacggctattcccacgtctccagaacccaccggcctggaggctacagctgcctccacctccaccctgccggctggagaggggcccaaggagggagaggctgtagtcctgccagaagtggagcctggcctcaccgcccgggagcaggaggccaccccccgacccagggagaccacacagctcccgaccactcatcaggcctcaacgaccacagccaccacggcccaggagcccgccacctcccacccccacagggacatgcagcctggccaccatgagacctcaacccctgcaggacccagccaagctgaccttcacactccccacacagaggatggaggtccttctgccaccgagagggctgctgaggatggagcctccagtcagctcccagcagcagagggctctggggagcaggacttcacctttgaaacctcgggggagaatacggctgtagtggccgtggagcctgaccgccggaaccagtccccagtggatcagggggccacgggggcctcacagggcctcctggacaggaaagaggtgctgggaggggtcattgccggaggcctcgtggggctcatctttgctgtgtgcctggtgggtttcatgctgtaccgcatgaagaagaaggacgaaggcagctactccttggaggagccgaaacaagccaacggcggggcctaccagaagcccaccaaacaggaggaattctatgcctgacgcgggagccatgcgccccctccgccctgccactcactaggcccccacttgcctcttccttgaagaactgcaggccctggcctcccctgccaccaggccacctccccagcattccagcccctctggtcgctcctgcccacggagtcgtggggtgtgctgggagctccactctgcttctctgacttctgcctggagacttagggcaccaggggtttctcgcataggacctttccaccacagccagcacctggcatcgcaccattctgactcggtttctccaaactgaagcagcctctccccaggtccagctctggaggggagggggatccgactgctttggacctaaatggcctcatgtggctggaagatcctgcgggtggggcttggggctcacacacctgtagcacttactggtaggaccaagcatcttgggggggtggccgctgagtggcaggggacaggagtccactttgtttcgtggggaggtctaatctagatatcgacttgtttttgcacatgtttcctctagttctttgttcatagcccagtagaccttgttacttctgaggtaagttaagtaagttgattcggtatccccccatcttgcttccctaatctatggtcgggagacagcatcagggttaagaagactttttttttttttttttaaactaggagaaccaaatctggaagccaaaatgtaggcttagtttgtgtgttgtctcttgagtttgtcgctcatgtgtgcaacagggtatggactatctgtctggtggccccgtttctggtggtctgttggcaggctggccagtccaggctgccgtggggccgccgcctctttcaagcagtcgtgcctgtgtccatgcgctcagggccatgctgaggcctgggccgctgccacgttggagaagcccgtgtgagaagtgaatgctgggactcagccttcagacagagaggactgtagggagggcggcaggggcctggagatcctcctgcagaccacgcccgtcctgcctgtggcgccgtctccaggggctgcttcctcctggaaattgacgaggggtgtcttgggcagagctggctctgagcgcctccatccaaggccaggttctccgttagctcctgtggccccaccctgggccctgggctggaatcaggaatattttccaaagagtgatagtcttttgcttttggcaaaactctacttaatccaatgggtttttccctgtacagtagattttccaaatgtaataaactttaatataaagtagtcctgtgaatgccactgccttcgcttcttgcctctgtgctgtgtgtgacgtgaccggacttttctgcaaacaccaacatgttgggaaacttggctcgaatctctgtgccttcgtctttcccatggggagggattctggttccagggtccctctgtgtatttgcttttttgttttggctgaaattctcctggaggtcggtaggttcagccaaggttttataaggctgatgtcaatttctgtgttgccaagctccaagccccatcttctaaatggcaaaggaaggtggatggccccagcacagcttgacctgaggctgtggtcacagcggaggtgtggagccgaggcctaccccgcagacaccttggacatcctcctcccacccggctgcagaggccagaggcccccagcccagggctcctgcacttacttgcttatttgacaacgtttcagcgactccgttggccactccgagaggtgggccagtctgtggatcagagatgcaccaccaagccaagggaacctgtgtccggtattcgatactgcgactttctgcctggagtgtatgactgcacatgactcgggggtggggaaaggggtcggctgaccatgctcatctgctggtccgtgggacggtgcccaagccagaggctgggttcatttgtgtaacgacaataaacggtacttgtcatttcgggcaaaaaaaaaaaaaaaaaa

SEQ ID NO: 380 - DNA, 3224 bp, Homo sapiens
aaagttccaaggagattttaaggtgcacgcaaggtggaaaaccactgctgaagcagatgtggagaactataaattaaggatcccagctacttaattgacttatgcttcctagttcgttgcccagccaccaccgtctctccaaaaacccgaggtctcgctaaaatcatcatggattcacttggcgccgtcagcactcgacttgggtttgatcttttcaaagagctgaagaaaacaaatgatggcaacatcttcttttcccctgtgggcatcttgactgcaattggcatggtcctcctggggacccgaggagccaccgcttcccagttggaggaggtgtttcactctgaaaaagagacgaagagctcaagaataaaggctgaagaaaaagaggtggtaagaataaaggctgaaggaaaagagattgagaacacagaagcagtacatcaacaattccaaaagtttttgactgaaataagcaaactcactaatgattatgaactgaacataaccaacaggctgtttggagaaaaaacatacctcttccttcaaaaatacttagattatgttgaaaaatattatcatgcatctctggaacctgttgattttgtaaatgcagccgatgaaagtcgaaagaagattaattcctgggttgaaagcaaaacaaatgaaaaaatcaaggacttgttcccagatggctctattagtagctctaccaagctggtgctggtgaacatggtttattttaaagggcaatgggacagggagtttaagaaagaaaatactaaggaagagaaattttggatgaataagagcacaagtaaatctgtacagatgatgacacagagccattcctttagcttcactttcctggaggacttgcaggccaaaattctagggattccatataaaaacaacgacctaagcatgtttgtgcttctgcccaacgacatcgatggcctggagaagataatagataaaataagtcctgagaaattggtagagtggactagtccagggcatatggaagaaagaaaggtgaatctgcacttgccccggtttgaggtggaggacggttacgatctagaggcggtcctggctgccatggggatgggcgatgccttcagtgagcacaaagccgactactcgggaatgtcgtcaggctccgggttgtacgcccagaagttcctgcacagttcctttgtggcagtaactgaggaaggcaccgaggctgcagctgccaccggcataggctttactgtcacatccgccccaggtcatgaaaatgttcactgcaatcatcccttcctgttcttcatcaggcacaatgaatccaacagcatcctcttcttcggcagattttcttctccttaagatgatcgttgccatggcattgctgcttttagcaaaaaacaactaccagtgttactcatatgattatgaaaatcgtccattcttttaaatgttgtctcacttgcatttccagtcttggccatcaaatcaatgatttaatgactccaataatgtgtgtgtttataaccatcctcgaaagtgaaatgtccttttctttgtgccatgcgtaaggtgagtcaaaccaaacctcattgataatctccctttggtttcctttgaaagtaaattggtatcttgtagttttgtgcacacgaaaggagagaaagtctctccagtaaagagtacgaactagtaattttggggggtctctctaattctggtattttgacatgttataatacgcaagtaaaataaaacaatagtttactcagctcatgttactattccccaacagatattgtggcaaatcacacataggaaagagaatttgggaatacagtagcaaaacataaattaaaactcaaatgccaggacaaaataaaacaatataccagatggagaggatgcccgtattttcatcttccattctaacattatccattgttagatgcataagcattttgatattgtgtaataaatgtggtatttgagaagataaatgatgtagttgatcagtattcctcctctatcacctttttagactttgtaaggtaaatatttggactaacttttagaaaagtttccctttttttctccatttacatttttctggtttttttttttttttgagtgaggtacgagtattaccaaatgatattttctgaagatgctttttggaaagctctgaatctatacctaatgctcttaattattggcttgtttcatttttttcctccagtttttaacaagatcacataactggcttatttttaacagctttgtcaaactacaatttacatgccgtaaaatgtacacactgtaattttataattcattgacttttagtaaatttctagcgttatgcatcgccacaatccagttttagaatatttccatgaccctaagaagtttcctcatgtctattaatattcccaatcctaggcaccactgagttgttttctgtctttataagtttttctttctacatcttatataaatggaatcataatacatgtagtattttgtgtctggcgtcttgcacttagcatggtgttcttgaggttcatctgttgtagtatgtattgatacttaatttttttattgccgaatactattccattgcatggaaaagacctattttatttctaggttcaccagttgagggacatttggattgttcccacttcttggctgttaggaataatgttgctctgaacatgtaaataaagatctttgtgttcacatatgttttcatttctgttggggagattcctaggctagaaattgctgggccatatgaaaaatcaatagttagctttgtaagaaacagtcaaactgttttccaacgtgacattttatattcccaccaggaatgtttaaaactagtgtcttcaaatcctcaccaacatccaggattgtgtctttatgattatagccatttttgtaggtacaaagtggcatctcatggtggttttaatttgcatttccataatatctaattaggttgagctttttttatgtgcttattggccatttgtttgactttgtttggtgaaatgtatacaaatcatttgctcatttttaatttgggttgtctgtcttgtcttctcattttattgagttaaatgagttcttaataatctctggcttacaagtccttaatttatcaaatatatgatacgtggacatttcctcataaaaaaaaaaaaaaaaaa

SEQ ID NO: 381 - DNA, 1996 bp, Homo sapiens
gccccagcaacggctcattctgctcccccgggtcggagccccccggagctgcgcgcgggcttgcagcgcctcgcccgcgctgtcctcccggtgtcccgcttctccgcgccccagccgccggctgccagcttttcggggccccgagtcgcacccagcgaagagagcgggcccgggacaagctcgaactccggccgcctcgcccttccccggctccgctccctctgccccctcggggtcgcgcgcccacgatgctgcagggccctggctcgctgctgctgctcttcctcgcctcgcactgctgcctgggctcggcgcgcgggctcttcctctttggccagcccgacttctcctacaagcgcagcaattgcaagcccatccctgccaacctgcagctgtgccacggcatcgaataccagaacatgcggctgcccaacctgctgggccacgagaccatgaaggaggtgctggagcaggccggcgcttggatcccgctggtcatgaagcagtgccacccggacaccaagaagttcctgtgctcgctcttcgcccccgtctgcctcgatgacctagacgagaccatccagccatgccactcgctctgcgtgcaggtgaaggaccgctgcgccccggtcatgtccgccttcggcttcccctggcccgacatgcttgagtgcgaccgtttcccccaggacaacgacctttgcatccccctcgctagcagcgaccacctcctgccagccaccgaggaagctccaaaggtatgtgaagcctgcaaaaataaaaatgatgatgacaacgacataatggaaacgctttgtaaaaatgattttgcactgaaaataaaagtgaaggagataacctacatcaaccgagataccaaaatcatcctggagaccaagagcaagaccatttacaagctgaacggtgtgtccgaaagggacctgaagaaatcggtgctgtggctcaaagacagcttgcagtgcacctgtgaggagatgaacgacatcaacgcgccctatctggtcatgggacagaaacagggtggggagctggtgatcacctcggtgaagcggtggcagaaggggcagagagagttcaagcgcatctcccgcagcatccgcaagctgcagtgctagtcccggcatcctgatggctccgacaggcctgctccagagcacggctgaccatttctgctccgggatctcagctcccgttccccaagcacactcctagctgctccagtctcagcctgggcagcttccccctgccttttgcacgtttgcatccccagcatttcctgagttataaggccacaggagtggatagctgttttcacctaaaggaaaagcccacccgaatcttgtagaaatattcaaactaataaaatcatgaatatttttatgaagtttaaaaatagctcactttaaagctagttttgaataggtgcaactgtgacttgggtctggttggttgttgtttgttgttttgagtcagctgattttcacttcccactgaggttgtcataacatgcaaattgcttcaattttctctgtggcccaaacttgtgggtcacaaaccctgttgagataaagctggctgttatctcaacatcttcatcagctccagactgagactcagtgtctaagtcttacaacaattcatcattttataccttcaatgggaacttaaactgttacatgtatcacattccagctacaatacttccatttattagaagcacattaaccatttctatagcatgatttcttcaagtaaaaggcaaaagatataaattttataattgacttgagtactttaagccttgtttaaaacatttcttacttaacttttgcaaattaaacccattgtagcttacctgtaatatacatagtagtttacctttaaaagttgtaaaaatattgctttaaccaacactgtaaatatttcagataaacattatattcttgtatataaactttacatcctgttttaccta

SEQ ID NO: 382 - DNA, 2868 bp, Homo sapiens
ggctgcgctccgagctgcggagtccgggactggagctgcccgggcgggttcgcgccccgaaggctgagagctggcgctgctcgtgccctgtgtgccagacggcggagctccgcggccggaccccgcggccccgctttgctgccgactggagtttgggggaagaaactctcctgcgccccagaggatttcttcctcggcgaagggacagcgaaagatgagggtggcaggaagagaagggcgctttctgtctgccggggtcgcagcgcgagagggcagtgccatgttcctctccatcctagtggcgctgtgcctgtggctgcacctggcgctgggcgtgcgcggcgcgccctgcgaggcggtgcgcatccctatgtgccggcacatgccctggaacatcacgcggatgcccaaccacctgcaccacagcacgcaggagaacgccatcctggccatcgagcagtacgaggagctggtggacgtgaactgcagcgccgtgctgcgcttcttcctctgtgccatgtacgcgcccatttgcaccctggagttcctgcacgaccctatcaagccgtgcaagtcggtgtgccaacgcgcgcgcgacgactgcgagcccctcatgaagatgtacaaccacagctggcccgaaagcctggcctgcgacgagctgcctgtctatgaccgtggcgtgtgcatctcgcctgaagccatcgtcacggacctcccggaggatgttaagtggatagacatcacaccagacatgatggtacaggaaaggcctcttgatgttgactgtaaacgcctaagccccgatcggtgcaagtgtaaaaaggtgaagccaactttggcaacgtatctcagcaaaaactacagctatgttattcatgccaaaataaaagctgtgcagaggagtggctgcaatgaggtcacaacggtggtggatgtaaaagagatcttcaagtcctcatcacccatccctcgaactcaagtcccgctcattacaaattcttcttgccagtgtccacacatcctgccccatcaagatgttctcatcatgtgttacgagtggcgctcaaggatgatgcttcttgaaaattgcttagttgaaaaatggagagatcagcttagtaaaagatccatacagtgggaagagaggctgcaggaacagcggagaacagttcaggacaagaagaaaacagccgggcgcaccagtcgtagtaatccccccaaaccaaagggaaagcctcctgctcccaaaccagccagtcccaagaagaacattaaaactaggagtgcccagaagagaacaaacccgaaaagagtgtgagctaactagtttccaaagcggagacttccgacttccttacaggatgaggctgggcattgcctgggacagcctatgtaaggccatgtgccccttgccctaacaactcactgcagtgctcttcatagacacatcttgcagcatttttcttaaggctatgcttcagtttttctttgtaagccatcacaagccatagtggtaggtttgccctttggtacagaaggtgagttaaagctggtggaaaaggcttattgcattgcattcagagtaacctgtgtgcatactctagaagagtagggaaaataatgcttgttacaattcgacctaatatgtgcattgtaaaataaatgccatatttcaaacaaaacacgtaatttttttacagtatgttttattaccttttgatatctgttgttgcaatgttagtgatgttttaaaatgtgatcgaaaatataatgcttctaagaaggaacagtagtggaatgaatgtctaaaagatctttatgtgtttatggtctgcagaaggatttttgtgatgaaaggggattttttgaaaaatctagagaagtagcatatggaaaactataatgtgtcttttttacaatgacttcagctctgtttttagctagaaactctaaaaacaaaaataataataaagaaaaataaataaaaaggagaggcagacaatgtctggattcctgttttttggttacctgatttcatgatcatgatgcttcttgtcaacaccctcttaagcagcaccagaaacagtgagtttgtctgtaccattaggagttaggtactaattagttggctaatgctcaagtattttatacccacaagagaggtatgtcactcatcttacttcccaggacatccaccctgagaataatttgacaagcttaaaaatggccttcatgtgagtgccaaattttgttttcttcatttaaatattttctttgcctaaatacatgtgagaggagttaaatataaatgtacagagaggaaagttgaggttccacctctgaaatgagaattacttgacagttgggatactttaatcagaaaaaaagaacttatcttgcagcattttatcaacaaatttcataattgtggacaattggaggcatttattttaaaaaacaattttattggccttttgctaacacagtaagcatgtattctctataaggcattcaataaatgcacaacgcccaaaggaaataaaatcctatctaatcctactctccactacacagaggtaatcactattagtattttggcatattattctccaggtgtttcttatgcacttataaaatgatttgaacaaataaaactaggaacctgctatacatgtgtttcataacctgcctcctttgcttggccctttattgagataagttttcctgtcaagaaagcagaaaccatctcatttctaacagctgtgttatattccatagtatgcattactcaacaaactgttgtgctattggatacttaggtggtttcttcactgacaatactgaataaacatctcaatagtcaaa

SEQ ID NO: 383 - DNA, 3249 bp, Homo sapiens
gacccgagacacgggagcgcttggcacgcggagccagagccggagctgcagccgcagcgggagccgggggagctcaggggccgcaggagccgggccggagtgagcgcacctcgcggggccctcggggcaggtgggtgagcgccacccggagtcccgcgcgcaactttcagggcgcactcggcggggcggctgcgcggctgccgggactcggcgcgggactgcatggaggccaaggagaagcagcatctgttggacgccaggccggcaatccggtcatacacgggatctctgtggcaggaaggggctggctggattcctctgccccgacctggcctggacttgcaggccattgagctggctgcccagagcaaccatcactgccatgctcagaagggtcctgacagtcactgtgaccccaagaaggggaaggcccagcgccagctgtatgtagcctctgccatctgcctgttgttcatgatcggagaagtcgttggtgggtacctggcacacagcttggctgtcatgactgacgcagcacacctgctcactgactttgccagcatgctcatcagcctcttctccctctggatgtcctcccggccagccaccaagaccatgaactttggctggcagagagctgagatcttgggagccctggtctctgtactgtccatctgggtcgtgacgggggtactggtgtacctggctgtggagcggctgatctctggggactatgaaattgacggggggaccatgctgatcacgtcgggctgcgctgtggctgtgaacatcataatggggttgacccttcaccagtctggccatgggcacagccacggcaccaccaaccagcaggaggagaaccccagcgtccgagctgccttcatccatgtgatcggcgactttatgcagagcatgggtgtcctagtggcagcctatattttatacttcaagccagaatacaagtatgtagaccccatctgcaccttcgtcttctccatcctggtcctggggacaaccttgaccatcctgagagatgtgatcctggtgttgatggaagggacccccaagggcgttgacttcacagctgttcgtgatctgctgctgtcggtggagggggtagaagccctgcacagcctgcatatctgggcactgacggtggcccagcctgttctgtctgtccacatcgccattgctcagaatacagacgcccaggctgtgctgaagacagccagcagccgcctccaagggaagttccacttccacaccgtgaccatccagatcgaggactactcggaggacatgaaggactgtcaggcatgccagggcccctcagactgactgctcagccaggcaccaactggggcatgaacaggacctgcaggtggctggactgagtgtcccccaggcccagccaggactttgcctaccccagctgtgttgtaaaccaggtccccctcctgacctctgccccactccaggaatggagctcttcccagcctcccatctgactacagccagggtggggactcagcgggtataaagctagtgtgaccctgctcttccagctcctgggccagctctggaagggctgtatttgggcctaatcctcagcaaatgttctaccactcgcaggggcaaaggtggtgagccacgggacgtccaaggggaggctggccccagcgcgcccatactgcctgcctcatgccccattctcagcctggctggcctttgcctttatgaatctgagcccctccatctgcctatagcaataggcacgggggtgaggaccctcacactctcatttgagcctccctgaggcagggagccaggaggcacctgaggcctatctgtgccttagtcacttcagctatgagccaaatgttccctttcctggaggggagaggcttcttactaggtaagagacaggtttcctctttccttatttcctcagctgtgccaacacaaaaaacaactttggcacaggtggtgggcagggggtagagagatttcagcttgggttctgcactaacagcctccaagccccctggcacttctgttgccctgagagtgtcccaggggattcagagtctccagaaagatatggctgggccaactctgttgcctacctggcctgacccagtcggagcctgacatggtggagggaaagggagacaagtggggctgcactcggtccagaggccagctaggagggaaaccgcagcttcctggggcttgtgtgtgaagattcctgacttaggggtggcttttgtttacaagatgcaagaggggaaacctgtccccgactcatcgagacaacatgcccagttatcagggagtcctgtgtcacaaggtctgtctctgccattgtaagcaagtgccttgggcgagctggcctctgccccacagtctcatctgtacaccgacagggttgatgcctccctcacagggttgagaacaagagccagttggccaagtacctgtggttgttgaagattggttacttttaccatcctggggacagggaactctgtggcccgaggctgcctcactgaggagtcaggtgggcttcccagcctccccaggggcagtgctgagtttgtcttgactgttctggcccaaggtgggaggaggtgggtttggtcacttgcctcccactttaaatctctgtctttccatctgtgaaatgacctctttgtgccttcccagcactgtcatcctgatcgcctgtgttctaggtaggtgggtccttcagcccctccaggtctgtgaaaagtctgtggaaagcactggcctggagaggggtggggggttgctggtgggtgctccattccaccacaatctcaggggactcaacctcccctacccaactccccacccccacccaagccatggcaggccccaggaacttgatcctgggctttgccgtatgccaagtccttacacccctctcaagagacagtcattggctgggcacggtggctcatgcctgcaatcccagcaccttgggaggctgaggcaggcagatgacttgaggccaggagttcgagaccagcctggccaatatggcgaaacctcatttctactaaaaatacaaaaactagccaggcgtggtggcttgtgcctgtaatcccagctactcgggaggctgaggcaggagaatcgcttgaaccggggaggcagaggttgcagtgagctgagatcacaccactgcactccagcctgggtgacagagcgagactccagctt

SEQ ID NO: 384 - DNA, 3115 bp, Homo sapiens
aacgcggaggacctctgggtgcctgcaggggagctgctccagccgggccgccgggagcggtggggagagcatcgcggagccgcccctccacgcgcccgcccagccgcgctcgcccactgggctctcccggctgcagtgccagggcgcaggacgcggccgatctcccgctcccgccacctccgccaccatgctgctcccccagctctgctggctgccgctgctcgctgggctgctcccgccggtgcccgctcagaagttctcggcgctcacgtttttgagagtggatcaagataaagacaaggattgtagcttggactgtgcgggttcgccccagaaacctctctgcgcatctgacggaaggaccttcctttcccgttgtgaatttcaacgtgccaagtgcaaagatccccagctagagattgcatatcgaggaaactgcaaagacgtgtccaggtgtgtggccgaaaggaagtatacccaggagcaagcccggaaggagtttcagcaagtgttcattcctgagtgcaatgacgacggcacctacagtcaggtccagtgtcacagctacacgggatactgctggtgcgtcacgcccaacgggaggcccatcagcggcactgccgtggcccacaagacgccccggtgcccgggttccgtaaatgaaaagttaccccaacgcgaaggcacaggaaaaacagtctccttgcaaatcttttccgttctgaattcagatgatgccgcagctccagcgttggagactcagcctcaaggagatgaagaagatattgcatcacgttaccctaccctttggactgaacaggttaaaagtcggcagaacaaaaccaataagaattcagtgtcatcctgtgaccaagagcaccagtctgccctggaggaagccaagcagcccaagaacgacaatgtggtgatccctgagtgtgcgcacggcggcctctacaagccagtgcagtgccacccctccacggggtactgctggtgcgtcctggtggacacggggcgccccattcccggcacatccacaaggtacgagcagccgaaatgtgacaacacggccagggcccacccagccaaagcccgggacctgtacaagggccgccagctacaaggttgtccgggtgccaaaaagcatgagtttctgaccagcgttctggacgcgctgtccacggacatggtccacgccgcctccgacccctcctcctcgtcaggcaggctctcagaacccgaccccagccataccctagaggagcgggtggtgcactggtacttcaaactactggataaaaactccagtggagacatcggcaaaaaggaaatcaaacccttcaagaggttccttcgcaaaaaatcaaagcccaaaaaatgtgtgaagaagtttgttgaatactgtgacgtgaataatgacaaatccatctccgtacaagaactgatgggctgcctgggcgtggcgaaagaggacggcaaagcggacaccaagaaacgccacacccccagaggtcatgctgaaagtacgtctaatagacagccaaggaaacaaggataaatggctcataccccgaaggcagttcctagacacatgggaaatttccctcaccaaagagcaattaagaaaacaaaaacagaaacacatagtatttgcactttgtactttaaatgtaaattcactttgtagaaatgagctatttaaacagactgttttaatctgtgaaaatggagagctggcttcagaaaattaatcacatacaatgtatgtgtcctcttttgaccttggaaatctgtatgtggtggagaagtatttgaatgcatttaggcttaatttcttcgccttccacatgttaacagtagagctctatgcactccggctgcaatcgtatggctttctctaacccctgcagtcacttccagatgcctgtgcttacagcattgtggaatcatgttggaagctccacatgtccatggaagtttgtgatgtacggccgaccctacaggcagttaacatgcatgggctggtttgtttcttgggattttctgttagtttgtcttgttttgctttccagagatcttgctcatacaatgaatcacgcaaccactaaagctatccagttaagtgcaggtagttcccctggaggaaataatattttcaaactgtcgttggtgtgatactttggctcaaaggatctttgcttttccattttaagcttctgttttgagttttgccctggggcttgaatgagtcccagagagtcgttcggatggtgggaggctgcctaggaggcagtaaatccagtcacagtgcctgggaggggcccatccttccaaaatgtaaatccagtcgcggtgtgaccgagctggctaacaggcttgtctgcctggttttcctcctacacgtggacattattctcctgatcctcctacctggtccaccccagggctaccggaaggtaaaatcttcacctgaaccaattatgagcagtctccttactgaaggtacagccggatacgtggtgcccccggggctggtgttggcagccggggggaggtgcctgagggtccccacggttcctttctgcttttctgaatgcatcaagggtacgagaacttgccaatgggaaattcatccgagtggcactggcagagaaggataggagtggaatgcccacacagtgaccaacagaactggtctgcgtgcataaccagctgccaccctcaggcctgggccccagagctcagggcacccagtgtcttaaggaaccatttggaggacagtctgagagcaggaacttcaagctgtgattctatctcggctcagacttttggttggaaaaagatcttcatggccccaaatcccctgagacatgccttgtagaatgattttgtgatgttgtgatgcttgtggagcatcgcgtaaggcttcttgcttatttaaactgtgcaaggtaaaaatcaagcctttggagccacagaaccagctcaagtacatgccaatgttgtttaagaaacagttatgatcctaaactttttggataatcttttatatttctgacctttgaatttaatcattgttcttagattaaaataaaatatgctattgaaacta

SEQ ID NO: 385 - DNA, 2450 bp, Homo sapiens
agatgtccccggccggcgagagcgggcgccggggttcgctctgagtcgcgtggcaggccgcgctgcgtccaccgctgccgagttcagagccgcgcaccgcccgccgccgcaggtcgggttcccagcgctactcccaagacaccgctcagccatgaagatgcatttctgtatcccggtgtcccagcagcggtccgacgcgctggggggccgctacgtgctgtactccgtgcacctggacgggttcctcttctgcagggtgcgctacagccagctgcacggttggaacgaacagctaaggcgggtctttggaaattgcctgccacccttcccaccaaagtactatctggcaatgaccacagctatggctgatgagaggagggaccaactggaacaatatttgcaaaatgtaaccatggacccaaacgtgttgagaagtgatgtcttcgttgagtttttaaaactggcgcagctgaatacatttgacatcgccaccaagaaagcttatctggacatatttctgcccaatgaacagagtattagaatcgaaattataacatcagacactgctgaaagagtcctagaggtggtgtcacacaaaattggactgtgtcgagagctcttgggctacttcggcctctttctcattcggtttggcaaggagggcaagctctctgttgtgaaaaaattggctgactttgaactcccttatgttagtcttggaagttctgaggtggaaaactgtaaggttggactccgaaagtggtatatggctccatccctcgactccgtgctgatggactgcagggtggcggtagatttgctctacatgcaggcaatacaggacattgaaaaaggatgggccaaacccacacaggcacagaggcagaaattagaagctttccagaaagaagacagtcaaacaaagtttttggagctggcccgggaggtacggcactatggatacctgcagctggatccttgtacctgtgactacccagaatcaggctctggagctgttctttctgttggcaataatgagatcagctgctgcatcaccctgcctgacagccagacccaggacatcgttttccagatgagcagggtgaagtgctggcaggtcactttccttggaactctgctggatacggatgggccccagagaactctcaaccagaacttagagctcagatttcaatacagtgaggatagttgctggcagtggtttgttatttacaccaaacaggcttttttgctgagtagctgcttgaaaaagatgatctcagaaaagatggtaaagctagctgctgagaatacagaaatgcagattgaagttccggaacaaagcaaaagtaaaaaataccacattcaacaaagccagcagaaagactattctagttttctatcaagaaaaagcaagattaagatagctaaagatgactgcgtttttgggaacataaaggaagaagatctctgaagaaagctctcatattttaaaatatccttggaggctatctcaagacagtgaaagaacttggggattcaggtgggctacctaccatcagtggaggaaatttgacctcttcccatttttttggcattaacatggactgtattcatcaaggtattataccacagcactctatggaaatctcaagattagaaaaaaaaaaagaaccaagttatagagttagtttttattttatttttgcacttcgtcatgacagtatagagtttgtttttaatgtctcataaatgacaagtggcaaattcaaatcaactcatataaaactcattctattttttctctaaaatagatctttatatggcttcatgaagtcttttatgtgttttgaatttacataaatgaaagtctcataaaatatcataaagatattttggatcgatttctaaagatgtgactcttcaacggaggagaatagggctctgagaaatggaatcactgaaaaagaaacctgggttctctgatctatccacacagaactagagcaaggaggtgatgaaatactgatctctttcctcacataagtctgagcctaccaatatggatgtactcaaagtgaaacgctgccctgttctctgcttgaccattgttataattttattctgtccttagagtactgaaggcagttcaataatcaacatgctatttggaatgttttaatttggaaagcaataaggctctgcacctgatatcagataccttataattctcttagctttaaaaatatgtatactttctcacaaggtttttccttatctagcttcatttctctcatggtaattaatgtaattatgtatagaattaagaccacaataagggagatgatcagaggaatctgtatagtgtaattagaaaaagtacaatattctaatgttctaactgggttgtatacctaattatataataaatacaaaataattccagtgaa

SEQ ID NO: 386 - DNA, 677 bp, Homo sapiens
aaacccctggtacctgagcactgatctgccttggagaacctgatcctgagactccagcaggatgtcttatcaacagcagcagtgcaagcagccctgccagccacctcctgtgtgccccacgccaaagtgcccagagccatgtccacccccgaagtgccctgagccctgcccaccaccaaagtgtccacagccctgcccacctcagcagtgccagcagaaatatcctcctgtgacaccttccccaccctgccagtcaaagtatccaccgaagagcaagtaacagcttcagaattcatcaggaccaagaaaggataaggatatttggctcacctcgttccacagctccaccttcatcttctcatcaaagcctaccatggatacacagggagcttctttctccttagccagtaatctgcccatgatgatccctgacagcaaaaagtttcttttctgaggctgccatactgccactgtccaggtggagactgagcaaaggaagtcctgggctgtgccagctcccagagcttcggaagaaagagcagcagctctctccctgggaaccatcagagaattctgttgatgtgttctgtgtctgtctgtcacctggtcacgagcttctaccacctttgcaattgtcacttatctttcactccctgaataaagtatctatgcatata

SEQ ID NO: 387 - DNA, 4977 bp, Homo sapiens
cctcctggcaaagcgtccagccctgcctgctcctcctcgggcctgggcgcctccagcaggcacttccctccctccctctctccccagctgcctcctcctcttctctccccgctctccttcccctttcaccccatcccctgccctggctgcaaccatgagggtcttggcctgcctccttgcggccctggtggggatccaggctgttgagcgcctgcgcctggccgatggcccccatgggtgcgctggccgcctggaggtctggcatggcgggcgctggggcaccgtgtgtgatgacggctgggacctgcgcgatgccgccgtggcctgccggcagctgggctgcggaggggcactggccgccccgggaggcgccttcttcggggagggggcagggcctgtgtggctcagcgagctggcttgccggggcaacgaggggcagctgggcctctgccaccaccggggctggaaggcccacatctgctcccacgaggaggacgcgggcgtcgtctgcgcaggtcagcgtgtggctaactccagggacgactcaacatctcccctggatggggctccctggccagggctgttgctggagctgagccccagcacggaggagcccctggtgacacatgccccccgcccagctgggaacccccagaacgcctcccggaagaagagcccccggcccaagcaggccaagtccacccgggcccctctgctgacgacaggagccccccgccaagagcggctgcgcctggtctctggcccccacaggtgcgccggacgcctggaggtctggcacggcgggcgctggggcaccgtatgtgacgatggctgggacctgcgcgacgctgctgtagcctgccgggaactgggctgtgggggggcgctggctgcccccggcggtgccagattcgggcctggtgcagggcccgtgtggatggacgatgtggggtgtggaggaggagaacaggccctccgagactgcccccgaagcccctggggccggagcaactgtgaccacagcgaggatgcggggctggtctgcaccggcccagcacctcggctgcgcctggccgatggcccccacgggtgcgccggccgcctggaggtctggcacgggggtcgctgggggtcggtgtgtgacgacgcctgggacctgcgagacgccgctgtggcctgccgagagctgggctgcggaggggcgctggccgcccccgggggcgccttctttggggaggggtctggacccatcatcctggacgaccttcggtgtcggggaaacgagacggccttacgattctgcccagctcggccctggggccagcatgactgtcaccaccgcgaggacgccggggccgtgtgtgacggcatgcccctgggctacgtccctcccacggcccccacggacagcaacaactccacgcccagggaggctgcctccaggcccccgtccaccatgacgagccaggctccagggacggcaggcgtttcacctcctccagcctcccctactgtcctttgggagcctggaccggaagccgggtccccccagctgcgcctggtggctgggcccagcaagtgctcaggtcgactggaggtgtggcatgaccagcgctgggggaccgtgtgtgacgatagctgggacatgcgggattcagctgtggtctgccgggagctgggctgtggtggacctcagcagccagaccctgctgctggccgctttggctggggtgcgggccccatctggctagatgatgtgggctgtgtggggaccgaggcttcactgtccgactgccctgctgctccctggggaaagcacaactgcgctcacaatgaggatgttggggtcacctgcactgggcccccaggcctggactccatctcagaccccttcagctggagctggattcctggactggggagagatcgggatgcctggctcccgggagagctggccaccaagccctctgcaagtgtgactgccagtgttctggagaaaacaaccacgaaggccccagggaaaatgcctaagagtactaagaagtgggtgacaaaaaatgcaaagagaccaaccactcaacccccagtgatgccaaccacgaaacactccagggcccaaagccccccagacctaacctcacagaccactgcagcactgaccactgaggcctcccgaagacctacctctgagtttaccagaaggccgaccacggaggccccccagagatggacctctcacaccactgccacgctgacccctcaggccccccgagaacggaccactaagaccatggcaatgctgaccactcaaggcccccaagaaatgacctctgagtccactatcaagagtatccctcaggcctccctggagccatctgctgagatcccagaagggtctccagagtcacccaaagacccggccccctctcccagtgttagcaccactggggaatcaggcctgttccgggttcgtctggccgatgggcccaaccgctgtgctggccggctggaagtgtggcatgccggacgctggggaacagtgtgtgatgacaactgggacctgcgggacgccactgtggcctgctgggaactgggctgtggaaaggtccggcctcgagtaggcaaaacccattacggccctgggactgggcccatctggctggatgacatgggctgtaagggaagcgaggcctcactgagcgactgcccctcgggggcttgggggaagcacaactgtgaccacgaggaagacgtggggctcacctgcactggctacacagactatgacgattatcccccctggacctgggaccccacctcaagagaggacctggccaaggggactaccacagcgggggtacctggacacactctcccctggaggaccacccggcgcccgggtagctcctccccagcaataaggcgcctgccggacacaggcagcaaagatggttacaagcttccctggacgtgggacacaccatcaggaaggggcctggctgaggggacccctaccgcaggcaaactaggaccaactcttggggctggcaccaccaggagcccaggcagtcctccaactctgagagtccatggagacacaggttccccgaggaaaccgtggcccgagcgccggccaccgcggcccgctgcgaccaggacagcgcccccaaccccgtccccaggtccctccgcctctccgggacccccaggcccagcgctgacctctgactccagtcgagagctcactccccactcagccttgacgtccgaggcgacctctgacgctccggacacttcaccacccaccccagacccggcctcccggacgaaccccgacctcatcttgacaagccctgactttgctttgtccacccctgactccagtgtggttcccgcgttgaccccggagccctcacccacgcccttacccaccttgcccaaagagctgacctctgacccttctacaccgtcggaggtgaccagcctttcccctacctcagagcaggtcccagaatctgacacaaccccagatttggacacaactccatactccagtacagtctcagaatattctagatccccagacccctccccaagccctcaccccactactacccctgatcccaccatggcccctgaccccatcacaacccttaaccctactgtgacccctcacttccctaccacccctcaccccaccacgacccctcaccccaccaccatcactcactccaccatgattcctgaccccaccacaacccctcaacccttcaccaccatcactcactccaccatgattcctgaccccaccacaacccctcaacccttcaccaccatgcagcccaccacaacccctcactccacaacccctcaccccaccacgacccctcatcccaccaccatcactcactccaccatgattcctgaccccaccacaacccctcaacccttcaccaccatgcagcccaccacgatgcctcatcccaccacgacccctcaccccaccacgactcctcaccccaccacaacccctcaccccaccacaacccctcaccccaccatgactcctgaccccaccacgaccccttaccccaccactactcctgatcccaccacgacccctcaccccacaactcctgacccttcctcaacccctgtcatcactactgtgtcccttccaacctccttggggacagaactctcctctcccactctagcaccaacagtcaagcccagtctgcacccccagttgaccttcacagcacctgcccctcacacctccacatcccagatacccaccttagagccctctccagccttggagtccagcccctccaggtcctccacagccacaagcatggacccactgtccactgaggacttcaagccacccagaagccagagccccaacctaacccctccacccacccataccccacactcagcctctgaccttactgtgtcccctgaccccctcctttcccccacagcccaccccttggatcatcctccccttgaccccctcaccctagggccaactcctggtcagagcccaggcccccatggtccatgtgtggccccaacaccacctgtaagggtcatggcttgtgagccacctgccctggtggagctggtggctgctgtgagggatgtgggtggtcagctgcagagactgacccaggtcgtggaacaggagcggcaggagcgccaagccctgctgctggggctgacgcagctggtagaagctgcccggggtctggggcagctgggtgaggctgtgaagagactggcagagatggcctggaccaccagcatgcctgcaccaaccaccactaccccagaggaagaagaaagacccctgaggggagacgtgtgaccctctccaggatttgaggggcttaagacacccccaaccaaaaaaaacaaaaacaaaaaaaacccccaaagtatctaattaaaaacaaggtgtgaatggta

SEQ ID NO: 388 - DNA, 4733 bp, Homo sapiens
agacgcccggtgaattctagaggcggcggagggtggcgaggagctctcgctttctctcgctccctccctctccgactccgtctctctctctctctctctctctcccctccctctctttccctctgttccattttttccccctctaaatcctccctgccctgcgcgcctggacacagatttaggaagcgaattcgctcacgttttaggacaaggaagagagagaggcacgggagaagagcccagcaagatttggattgaaaccgagacaccctccggaggctcggagcagaggaaggaggaggagggcggcgaacggaagccagtttgcaattcaagttttgatagcgctggtagaagggggtttaaatcagatttttttttttttaaaggagagagactttttccgctctctcgctccctgttaaagccgggtctagcacagctgcagacgccaccagcgagaaagagggagaggaagacagatagggggcgggggaagaagaaaaagaaaggtaaaaagtcttctaggagaacctttcacatttgcaacaaaagacctaggggctggagagagattcctgggacgcagggctggagtgtctatttcgagctcagcggcagggctcgggcgcgagtcgagaccctgctcgctcctctcgcttctgaaaccgacgttcaggagcggctttttaaaaacgcaaggcacaaggacggtcacccgcgcgactatgtttgctgatttttcgccttgccctctttaaaagcggcctcccattctccaaaagacacttcccctcctccctttgaagtgcattagttgtgatttctgcctccttttcttttttctttcttttttgttttgctttttccccccttttgaattatgtgctgctgttaaacaacaacaaaaaaacaacaaaacacagcagctgcggacttgtccccggctggagcccagcgccccgcctggagtggatgagcctctccatgagagatccggtcattcctgggacaagcatggcctaccatccgttcctacctcaccgggcgccggacttcgccatgagcgcggtgctgggtcaccagccgccgttcttccccgcgctgacgctgcctcccaacggcgcggcggcgctctcgctgccgggcgccctggccaagccgatcatggatcaattggtgggggcggccgagaccggcatcccgttctcctccctggggccccaggcgcatctgaggcctttgaagaccatggagcccgaagaagaggtggaggacgaccccaaggtgcacctggaggctaaagaactttgggatcagtttcacaagcggggcaccgagatggtcattaccaagtcgggaaggcgaatgtttcctccatttaaagtgagatgttctgggctggataaaaaagccaaatacattttattgatggacattatagctgctgatgactgtcgttataaatttcacaattctcggtggatggtggctggtaaggccgaccccgaaatgccaaagaggatgtacattcacccggacagccccgctactggggaacagtggatgtccaaagtcgtcactttccacaaactgaaactcaccaacaacatttcagacaaacatggatttactatattgaactccatgcacaaataccagccccggttccacattgtaagagccaatgacatcttgaaactcccttatagtacatttcggacatacttgttccccgaaactgaattcatcgctgtgactgcataccagaatgataagataacccagttaaaaatagacaacaacccttttgcaaaaggtttccgggacactggaaatggccgaagagaaaaaagaaaacagctcaccctgcagtccatgagggtgtttgatgaaagacacaaaaaggagaatgggacctctgatgagtcctccagtgaacaagcagctttcaactgcttcgcccaggcttcttctccagccgcctccactgtagggacatcgaacctcaaagatttatgtcccagcgagggtgagagcgacgccgaggccgagagcaaagaggagcatggccccgaggcctgcgacgcggccaagatctccaccaccacgtcggaggagccctgccgtgacaagggcagccccgcggtcaaggctcaccttttcgctgctgagcggccccgggacagcgggcggctggacaaagcgtcgcccgactcacgccatagccccgccaccatctcgtccagcactcgcggcctgggcgcggaggagcgcaggagcccggttcgcgagggcacagcgccggccaaggtggaagaggcgcgcgcgctcccgggcaaggaggccttcgcgccgctcacggtgcagacggacgcggccgccgcgcacctggcccagggccccctgcctggcctcggcttcgccccgggcctggcgggccaacagttcttcaacgggcacccgctcttcctgcaccccagccagtttgccatggggggcgccttctccagcatggcggccgctggcatgggtcccctcctggccacggtttctggggcctccaccggtgtctcgggcctggattccacggccatggcctctgccgctgcggcgcagggactgtccggggcgtccgcggccaccctgcccttccacctccagcagcacgtcctggcctctcagggcctggccatgtcccctttcggaagcctgttcccttacccctacacgtacatggccgcagcggcggccgcctcctctgcggcagcctccagctcggtgcaccgccaccccttcctcaatctgaacaccatgcgcccgcggctgcgctacagcccctactccatcccggtgccggtcccggacggcagcagtctgctcaccaccgccctgccctccatggcggcggccgcggggcccctggacggcaaagtcgccgccctggccgccagcccggcctcggtggcagtggactcgggctctgaactcaacagccgctcctccacgctctcctccagctccatgtccttgtcgcccaaactctgcgcggagaaagaggcggccaccagcgaactgcagagcatccagcggttggttagcggcttggaagccaagccggacaggtcccgcagcgcgtccccgtagacccgtcccagacacgtcttttcattccagtccagttcaggctgccgtgcactttgtcggatataaaataaaccacgggcccgccatggcgttagcccttccttttgcagttgcgtctgggaaggggccccggactccctcgagagaatgtgctagagacagcccctgtcttcttggcgtggtttatatgtccgggatctggatcagattctgggggctcagaaacgtcggttgcattgagctactgggggtaggagttccaacatttatgtccagagcaacttccagcaaggctggtctgggtctctgcccaccaggcggggaggtgttcaaagacatctccctcagtgcggatttatatatatatttttccttcactgtgtcaagtggaaacaaaaacaaaatctttcaaaaaaaaaatcgggacaagtgaacacattaacatgattctgtttgtgcagattaaaaactttatagggacttgcattatcggttctcaataaattactgagcagctttgtttggggagggaagtccctaccatccttgtttagtctatattaagaaaatctgtgtctttttaatattcttgtgatgttttcagagccgctgtaggtctcttcttgcatgtccacagtaatgtatttgtggtttttattttgaacgcttgcttttagagagaaaacaatatagccccctacccttttcccaatcctttgccctcaaatcagtgacccaagggagggggggatttaaagggaaggagtgggcaaaacacataaaatgaatttattatatctaagctctgtagcaggattcatgtcgttctttgacagttctttctctttcctgtatatgcaataacaaggttttaaaaaaataataaagaagtgagactattagacaaagtatttatgtaattatttgataactcttgtaaataggtggaatatgaatgcttggaaaattaaactttaatttattgacattgtacatagctctgtgtaaatagaattgcaactgtcaggttttgtgttcttgttttcctttagttgggtttatttccaggtcacagaattgctgttaacactagaaaacacacttcctgcaccaacaccaataccctttcaaaagagttgtctgcaacatttttgttttcttttttaatgtccaaaagtgggggaaagtgctatttcctattttcaccaaaattggggaaggagtgccactttccagctccacttcaaattccttaaaatataactgagattgctgtggggagggaggagggcagaggctgcggtttgactttttaatttttcttttgttatttgtatttgctagtctctgatttcctcaaaacgaagtggaatttactactgttgtcagtatcggtgttttgaattggtgcctgcctatagagatatattcacagttcaaaagtcaggtgctgagagatggtttaaagacaaattcatgaaggtatattttgtgttatagttgttgatgagttctttggttttctgtatttttccccctctctttaaaacatcactgaaatttcaataaatttttattgaaatgtc

SEQ ID NO: 389 - DNA, 2812 bp, Homo sapiens
gccgagccccgccggagggaggcggctccgcgcggggcccgccgcccgcgccgccgccaccgaaacccggccgcggcgcgcccgaccttctgcgccggctgccgcggccgccctcgccgcgctcccgccccggccgctgcccctgcccgccccgctcgccccgcgcaccccaacccggggaggggctcccacgaccccgggcgcgcgcgcttgggggcgcgccagggactccagggtcccttgccccgcgccgcttctccctcctccctctttcttcgggcagcctccccaccaccccacttcagcctcccccactcttgccgcctccatatcatcaagctctggtggcgcctggggggcttttcggatcggcaggatgtacccccagggaaggcacccgaccccgctccagtccggccagcccttcaagttctcgatcttggagatctgcgaccgcatcaaagaagaattccagtttcttcaggctcaataccacagcctcaagctagaatgtgagaagctggccagcgagaagacggaaatgcagcgacattatgtcatgtattatgagatgtcgtacgggctcaacattgaaatgcataagcaggcggagattgtgaagcgtctgagcggtatctgcgctcagattatccccttcctgacccaggagcatcagcagcaggtgctccaggccgtagaacgcgccaagcaggtcaccgtgggggagctgaacagcctcatcgggcagcagctccagccgctgtcccaccacgcaccccctgtgcccctcaccccccgcccagccgggctggtgggcggcagtgctacggggctgcttgctctgtctggagccctggctgcccaggctcagctggcggcggctgtcaaggaggaccgtgcgggcgtggaggccgaggggtccagagtggagagagccccgagcaggagtgcatctccctcgccccctgagagtctcgtggaggaggagcgaccgagtggccctggtggtggcgggaagcagagagcagatgagaaggagccatcaggaccttatgaaagcgacgaagacaagagtgattacaatctggtggtggacgaggaccaaccctcagagccccccagcccggctaccaccccctgcggaaaggtacccatctgcattcctgcccgtcgggacctggtggacagtccagcctccttggcctctagccttggctcaccgctgcctagagccaaggagctcatcctgaatgaccttcccgccagcactcctgcctccaaatcctgtgactcctccccgccccaggacgcttccacccccgggcccagctcggccagtcacctctgccagcttgctgccaagccagcaccttccacggacagcgtcgccctgaggagccccctgactctgtccagtcccttcaccacgtccttcagcctgggctcccacagcactctcaacggagacctctccgtgcccagctcctacgtcagcctccacctgtccccccaggtcagcagctctgtggtgtacggacgctcccccgtgatggcatttgagtctcatccccatctccgagggtcatccgtctcttcctccctacccagcatccctgggggaaagccggcctactccttccacgtgtctgcggacgggcagatgcagccggttcccttcccctcggatgcactggtaggcgcgggcatcccgcggcacgcccggcagctgcacacgctggcccatggcgaggtggtctgcgcggtcaccatcagcggctccacacagcatgtgtacacgggcggcaagggctgtgtgaaggtgtgggacgtgggccagcctggggccaagacgcccgtggcccagctcgactgcctgaaccgagacaactacattcgttcctgcaagttgctgccggatggccggagtctgatcgtgggcggtgaggccagcaccttgtccatttgggacctggcggcgcccaccccccgtatcaaggccgagctgacttcctcagccccagcctgctacgccctggccgtcagccccgacgccaaggtttgcttctcctgctgcagcgatggcaacattgtggtctgggacctgcagaatcagactatggtcaggcagttccagggccacacggacggcgccagctgcattgatatttccgattacggcactcggctctggacagggggcctggacaacacggtgcgctgctgggacctgcgggagggccgccagctgcagcagcatgacttcagctcccagattttctccctgggccactgccctaaccaggactggctggcggtcggaatggagagtagcaacgtggagatcctgcacgtccgcaagccggagaaataccagctgcacctccacgagagctgcgtgctgtccctgaagtttgcctcctgcggacggtggtttgtgagcaccgggaaggacaacctgctcaacgcctggaggacgccgtacggggccagcattttccagtccaaggagtcgtcctcagtcctgagttgtgacatctccagaaataacaaatacatcgtgacaggctcgggggacaagaaggccaccgtgtatgaggtggtctactgagacatgaccccccttcctgtacccgaagtccagactcccaggggaatcagcagccaggacagacatcctagcagccgcctcccagccctgcctaggaaccgtacatcccatctgctctctggccaacggcttcacaccttcccctgctgcatgtgggggccgatgggcaggggacctcggtggaaataaaatgtatctatcaca

SEQ ID NO: 390 - DNA, 4959 bp, Homo sapiens
gtctccgcggctcgtctcctcagtccgcccggggaggaggaggaggagcggggccagccgccgccgccgccgccgtcccagcctcgcccagcgcacctgaactcgcctcgccgacccgggccccagcgccgcgccccgcgcccccggcgcccggcccgcgcgcagcgctgcctcggtgccccggcggggcgcgtccccccggccgcctcccgctctcccgcggctcgcgtggccgcgcctttgtgtgcggcggccgcggctcccgagctcctcgggctctgggtcccggcgcccctccggccgcgagtcccacgcgccacccccgggcgccctcgacggtggatctagcggcggcgaggaggcgggtcccggccccggcgaaccccagtcccggcccccggccccgggcccagcttcggcatggatgtgaggttctaccccgcggcggccggggaccctgccagcctggacttcgcgcagtgcctggggtactacggctacagcaagtttggaaataataataactatatgaatatggctgaggcgaacaatgcgttcttcgctgccagtgagcagacattccacacaccaagccttggggacgaggaattcgaaattccaccaatcacgcctcctccagagtcagaccctgccctaggcatgccggatgtactgctaccctttcaagccctcagcgatccattgccttcccagggaagtgaattcacaccccagtttccccctcaaagcctggacctcccttccattacaatctcaagaaatctcgtggaacaagatggcgtgcttcatagcagtgggttgcatatggatcagagccacacacaagtgtcccagtaccggcaggatccctccctgatcatgcggtccatcgtccacatgaccgatgctgcgcgttctggggtcatgcctcctgcccagctcaccaccatcaaccagtctcagctcagcgcccagttggggttgaatttgggaggtgccagtatgcctcacacatctccttcacctccagcaagcaaatcagccactccctccccttccagctccatcaatgaagaggatgctgatgaagccaacagagccattggagagaaaagagctgctccagactctggcaagaagcccaagactccaaagaaaaagaaaaagaaagatcccaatgagccacagaagccagtgtcagcatatgccctgtttttcagagacacacaggctgcaattaaaggtcaaaaccccaatgcaacctttggagaggtctcaaaaattgtagcatctatgtgggacagccttggagaagaacaaaagcaggtatataaaaggaaaacagaagctgccaaaaaagaatacctgaaggccctggcggcatacagggccagcctcgtttctaaggctgctgctgagtcagcagaagcccagaccatccgttctgttcagcagaccctggcgtcgaccaatctaacatcctctctccttctcaacactccactgtctcaacatggaacagtgtcagcatcacctcagactctccagcaatccctccctaggtcaatcgctcccaaacccttaaccatgagactccccatgaaccagattgtcacatcagtcaccattgcagccaacatgccctcgaacattggggctccactgataagctccatgggaacgaccatggttggctcagcaccctccacccaagtgagtccttcggtgcaaacccagcagcatcagatgcaattgcagcagcagcagcagcagcaacaacaacagatgcaacagatgcagcagcagcaactccagcagcaccaaatgcatcagcaaatccagcagcagatgcagcagcagcatttccagcaccacatgcagcagcacctgcagcagcagcagcagcatctccagcagcaaattaatcaacagcagctgcagcagcagctgcagcagcgcctccagctgcagcagctgcaacacatgcagcaccagtctcagccttctcctcggcagcactcccctgtcgcctctcagataacatcccccatccctgccatcgggagcccccagccagcctctcagcagcaccagtcgcaaatacagtctcagacacagactcaagtattatcgcaggtcagtattttctgaagacgcatatggcagacggatttgcgtataccaaggagagtggcataggagggaaaagcatatgtggctgaaacctgtaagttggtgttggttatgcagaaatgtgtaacagatcaaacggtcctctcaagtgtctattagataggcaataagaactgcagtgtagctgagtaacatcttttagctgactataaatcactttgtttttaaacaagaaaagctgtgctcttttatgtgatgccttttttatttattcaggctatacctacaatatgtgaatcaaactgtttaatgaatcctgggacatactgatgactataaactggcctctctgagtcatagaaaaatggccttatttctccagaagtgagtaaaccacacttccaggctatctgaactcctgaagccctaaaaataaaaagcacagttgtaactacctgaaatatgaagatccagtttcatacaaacatttgtatgacgtgaatagttgatggcatttttttgtcatgaaaaaaataatgtaaatcacagacttttgccaaagctcttattttttttcctaaatctctccagaaaaaaaatgcaagtgactaaattcaattattgactaatttccactttttatccatgacttctccaaatcaaaccacagtatatgttgtaacaatatctatgaccactgttagcccattatattcattccaattagaagaaatgtgaatactatattccgtgttttgagtgacaagtttcgaaaaataaaaacactgtatttttaaaagggaaatgcacttaaatgaaaacagttattacaaaagttaagatttaaaaagaaaaagcaagagtttttattatgatgtaataccagtagaatatttaaaaggcacaccacatctgaataatcaatgtaaatattttctttcaaagttgtaagttttcatatcatgtgctgtaaagttttcctaaatgaggctttaacgtaaacactggtgacataaaccattcattgctacgttgcttattgtgtttttatgctgttttatacttttttatgagttatgatagcagcaattaagttgtttgtattttgcttaactaaaacaaaaatgcttttatcttgctatagaataaacacatttcagtaaaaactgtggactgtattttgatgcaacaacaaagaaactgttcacttttcaaataaaatgatatgtcagatttcatttttggttccttgaatacatgtaagatggggaaatatgccacataccaagtttcgttttagcccaaacatcatcttccatttttcaattggaaatatgatatttatggccaagaatatgcattgcatagcctgaaatgaagatccttgaaaaaaccaaaacaacgcattggaaatatttgtgtaattgtcttttttttttttttttttttttttaagatgcaagtacaaggtaagtatagagaaaaaagtaatcgcttttttgagggggctagaactagctgggtattgtaatgttattgcgattaaaatagatggtgaatgctaattcttaagccaaaataattatttcggtgcccatttattccccccttttcttgctctgtagcggttcctctttgagagcagtgtgaccactatccccagttgtcttgcatgattaattacagcatctgtcctgtcagaagctataatgaagaggtcttgataaaaattgcaaattaccactggcaacagtcttaaactgcttatgataaaatgaaaattaaaaacagcaagtgtcaaccctgaccagaatcctaatctggaaagaatgagggtgtgcgtggtgcgctccacagctactatgtgcaagacattcaaaaataatggaatatggatccctcaaagttgttgtatttcagagattatttactgtatgttgtgggttatgaataatgaattcagctttcaatatttcataatcctctcctactctgtattatgtacaaatattgaacagcaagagattctaattataaatttatggatttcttgctgtagaaaaatttatgtctaaattgaagcttttcataagatgtattagttgacaggtatcagtgttcaaacagccttagaatgatgcctaattacatctacaagggagtgattgtattccacaaagaaatgatgtgctagcatcagatccttcagaagtagagctcgaatggtaaaagattttctgtgaattgaaactaacattacataacaataaccattttatattctgttgtgaaacctttagacagatgtcttcaaaattaattgctaaactacatgtgacagtaattgtgtattagttctgtaattgtcattttgaaaacccatgaagtattgcttggaaaaaaatgtcactagtgataagacttaattgcaagtgaagtctgttttcaactgtttgcagttagaagcaggtgttgtaacatctattaaatgattttataaatcttgggttttatcacatttgattaaatgctgctaagccactgatggtcaattccagaggaaaaaaaaagtttaatgactacagtttataaaattaatcaccaggcaaaactacatatttaaaatgtcaaaaggcttgaatcatgaaaagaattcctcaaccttgttaccaaattattgttttcaggattcacaaagcatgttatatatccatttatatttcagtttatacatatgactggtttctattcctgagacttaagtaagtacttggtgcgctttttcttttgttacaggtcagaaataaatcaggataatgaaaaata

SEQ ID NO: 391 - DNA, 1284 bp, Homo sapiens
cagagaggctgcagacagagaaggatgatggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatggtagccagttttggtgtgggtgccgcactctgccgccgccggtccatggtcctcacgtacctggtgctcatgctcatcgtctacatcttcgagtgcgcctcctgcatcacgtcctacacccaccgtgactacatggtgtccaacccatccctgatcaccaagcagatgctgaccttctacagcgcggacaccgaccagggccaggagctgacccgcctctgggaccgcgtcatgattgagcaagaatgctgtggcacatctggtcccatggactgggtgaacttcacgtcagccttccgggcggccactccggaggtggtgttcccctggcccccactgtgctgtcgccggacgggaaacttcatccccctcaacgaggagggctgccgcctggggcacatggactacctgttcaccaagggctgcttcgaacacatcggccacgccatcgacagctacacgtggggtatctcgtggtttgggtttgccatcctgatgtggacgctcccggtcatgctgatagccatgtatttctacaccatgctctgagggacaggaggggaaggcaacatacacaccccggactcctccgcatcctcctcctgcttcctccgctgggcctggatggctgcctcacctctcacctcccaacgtccctagcccttacgtccttccacttccaagatctttttccaggttcctgagccctactgtgtctcaggtgtgccctgaaaccccagggcttgtgtgcacatatccttagcccatctttcaagggacctctccatgatcccacctcccattcacagatacctctcttgtagctctctgacctcctccttcatggcaggcatcgccattcttgctgaaccgtttgtgattgccatttgagctctggaagcctctattgccatgagagttctgtcacggtcactttactgtccccatcatcacccagcacggggctaagcatatactagatagtcaataaataaataaataatgaatgaatgaaaaaaaaaaaaaaaa

SEQ ID NO: 392 - DNA, 1084 bp, Homo sapiens
aggtctggtgcccgcgcctgctcgctggaccgcccgccccgcgctctggcggctcctcccgggcgatgcctccgctctgggccctgctggccctcggctgcctgcggttcggctcggctgtgaacctgcagccccaactggccagtgtgactttcgccaccaacaaccccacacttaccactgtggccttggaaaagcctctctgcatgtttgacagcaaagaggccctcactggcacccacgaggtctacctgtatgtcctggtcgactcagccatttccaggaatgcctcagtgcaagacagcaccaacaccccactgggctcaacgttcctacaaacagagggtgggaggacaggtccctacaaagctgtggcctttgacctgatcccctgcagtgacctgcccagcctggatgccattggggatgtgtccaaggcctcacagatcctgaatgcctacctggtcagggtgggtgccaacgggacctgcctgtgggatcccaacttccagggcctctgtaacgcacccctgtcggcagccacggagtacaggttcaagtatgtcctggtcaatatgtccacgggcttggtagaggaccagaccctgtggtcagaccccatccgcaccaaccagctcaccccatactcgacgatcgacacgtggccaggccggcggagcggaggcatgatcgtcatcacttccatcctgggctccctgcccttctttctacttgtgggttttgctggcgccattgccctcagcctcgtggacatggggagttctgatggggaaacgactcacgactcccaaatcactcaggaggctgttcccaagtcgctgggggcctcggagtcttcctacacgtccgtgaaccgggggccgccactggacagggctgaggtgtattccagcaagctccaagactgagcccagcaccacccctgggcagcagcatcctcctctctggccttgccccaggccctgcagcggtggttgtcacaccctgacttcagggaaggtgaaacagggcttgtccctccaactgcaggaaaacccttaataaaatcttctgatgagttcta

SEQ ID NO: 393 - DNA, 3158 bp, Homo sapiens
agtttcacccagcaagcgtgagaacaggtactgcttcctgagcaccgccagccaccggcaccaagaccggccacatcccagcactgcccacctctgctcccagccgccagatgacggaggctctcgccagaccctcagcacgcagagctggcttctgatagaagtgatcgggaaagaaagcaaagcgggaggtgcctctttagaaaccacgaagtgcacgcggcgtcgacagtgatcacgccacctggacagccagagtccaaggcataaggaggaaaatgagtctcctcaaagagcggaagccaaaaaagccacattacatccccaggcctccaggaaagcccttcaagtataaatgtttccaatgtccctttacttgcaatgagaagtcacatctttttaatcacatgaagtatggtctttgtaaaaactcgattactttagtatcagagcaggatcgagttcccaagtgccctaaatctaactcactagaccccaagcaaaccaaccagcccgatgccacggcgaagccagcctcttccaagtctgtcgcaaatggactctctgccttcgactcgaagcttcagcacagctctgccagggaagacatcaaggaaaacctggagctgcaagcccggggaacccacaggtgcctgggacagaagccagccctccacagggcatcaccctgcaagagcccagctccggaagccgccctcggtgcccagcctgctctggaaggcgcagctcggccttctgcatttgttccagtcggcgagcacagactcaaggggccagacaacgccgaggcgcccgagacactggctttacacaaccccactgccaaggccgtgtctttccacaccaagtcggccttccacactcctggctacccctggaaagccggctcacctttccttccaccagagtttccacataaaatctcatctacaaaggggcttggggccatttccccttacatgcaccccacaatcccagagtacccgcctcacttttacacagagcacgggctggccaccatctactcgccttacctgctggctgggagctcgcctgagtgtgacgcacccctgctgtcagtctacggaacccaagacccgagacacttcctgcctcacccggggccgatccctaagcacctggctccatctccagccacatacgatcactacaggtttttccagcaatatccctctaacctgccgattccttacggattttacaggccagagtctgcattttcctcctatggtctcagactcccacctgtcactggcctcacccgagatcagagctctcacctgcttgaagaagccaccctggtctatccagcctcgagtccttccaggttaaacccttcggaccccaacagaaaacacgtcgagttcgaaagtccaattcctgaggctaaagactcctccaaggctgggcagagagacacggaagggtccaaaatgagcccccgcgcagggagtgcagccacgggctccccagggaggccgagccccaccgacttcatgcagacgagccagacctgcgaaggcctgtacgacctctccaacaaggcagcctccagcgcactgggaagactctacccgccagagcaaagcctcacagccttcaggcctgttaagaaaagcacagaatgcctacctgcccaggctgctgagaccacagcagagtctccagtaagcctcaatgttgtgaacggagaccctcctgctccgaccggaagcgcctctctcgtctcggaggccgcgccttccagtccggacgacagctccgggatgggccccctcaacctctccaagaaatcagagataaacctggcagccacccacgaacccacgtaccaaggcagcccccaggcggaaaccgccagcttctcagagctgcaggaccttccactcaatctctcggtgaaggacccctgtaacacccaggctccgaggcctgccttccccggtcgaccacgagctgcagaacctgctgctgctgttccacagaagactgggacagaaggttctgaggatgggcccagccaccctgagaccaagccaggcagcctcgacggtgacggggccccacccacaggccccggcgaggaggctccagacgcatgcgcggtggacagcagcgaggagcagaagcagacggcagccgtggccctgtgccagctggcggcctacagccccaggaacatccgggtgggcgatggggatgctgcggccccggaacctgcctgccggcaagacacacccacactgagctccatggagagccaagaggcccagtgtgacctcagacccaaaggacaaaagaggacaagtctaagggatgctggaaaatcccagcaaggagctaagaaggcgaagctgcaggacacggccagagtgttcacactacgaaggagggcccgggtgtcctaacgccgggttcacacgtgtgttcacagagctacggccacacacacgccttccaaggtggcaagctacaacacctctgaactggcactttcacatttttacaaatgcagctgctgcttctcaaaaaaacaaacaaacaaacaaacaaaaaaccctccaattcagtttttataaatattaagcatgaatattaaaaggtgcttctacttttggttgtaaaaacacctgaatgactctaagactgatatgtattttcaagtctaagctgtcttacagaagatcttttataaatgtttccttataaatatctcaccattacaacaaattgttttaactgtttttctattagctctagctgcatatttgatgtaaatgacaattactgaaaaaatgtcagaaaaaacattttcagtactaacattaaagtgccatatgtaaaaaagaaaaatgtgatttgtataactaaataacacacaaacatcaagaggctatttatacaaataatttatttccactagggaaagtgcattactggtgaaggtattatcaatttattctacttgcttataatgttacagtgaatgttctggcttactctgcctcactttccattccccaaaatgatgtgtatgttgctaattttccaataaactcatatgaaccataaggaaacataaaatgcaaataaacataaatctatgttatccttta

SEQ ID NO: 394 - DNA, 3288 bp, Homo sapiens
accattcttccggtttcagaagttaaggctggtgtcctggccccagtccacctctgggagcgcctgcgccgctccgcggagagtccgtggatctcacagtgaaaaatgtttgctgacccttgacattgacaaactgctgacagctcagatgatccatgattggaaggatgtggtcatcaccaagatgtctttctttctccggttcccagttttccagacctgaagtgttttccaatcaaagcgaagagacgatctgtggatgttgaatatgcaaggagctgaagagagagacattagaagagagacttgtccaggctgggtaaacaagaacaagcctgctctggagcaggatgtctgtaaaattgactcatcagggatagtagtaaagaggttccaagaggatgaataccaagattctacatttgaagaaaaatatgcatgtgagggcatgaaggaaaactctcctagggagattgctgaatcatgccttttccaggaaggaggttttgggagaataactttcatccacaaagaagcaccccctgaaattattagtcaaggatataattttgagaaaagcttgcttttgacctcaagccttgttacacgtctcagggtttctacagaagagagtctgcatcagtgggaaacaagtaatatacaaaccaatgatatttcagaccaaagtaaatgtccaactctctgcacacagaaaaaatcttggaaatgtaatgaatgtggaaaaacctttactcagagctcatcccttacccaacatcagagaactcatactggagagagaccctacacatgtgaggaatgtgggaaagcctttagtcgtagttcattccttgttcaacatcaaagaattcacactggagtgaaaccatatggatgtgagcagtgtgggaaaacatttcgatgtcgatcatttcttactcagcatcaaagaattcacactggagagaaaccttataaatgcaatgaatgtgggaattccttccgcaatcactcacatctcactgaacaccagagaattcacactggagagaaaccttataaatgcaataggtgtgggaaggcattcaatcagaatacacaccttattcatcatcagagaattcacactggtgagaagccttacatatgcagtgaatgtggctcttcttttcgaaaacactcaaatcttacgcaacatcagagaattcacactggggaaaaaccccataaatgtgacgaatgtgggaaaactttccaaacaaaggcaaacctctctcagcatcagagaattcatagtggagagaaaccctataaatgtaaagaatgtggcaaagccttttgtcagagcccatctcttattaaacaccagcgaattcatactggagaaaaaccatataagtgtaaagaatgtggcaaagcgtttactcagagcaccccactcactaaacatcagagaatacatacaggggagagaccctacaaatgcagtgaatgtggtaaagccttcattcagagcatttgccttattcggcaccagagaagtcacactggagaaaaaccctataaatgcaatgaatgtggaaagggctttaatcagaacacctgcctcactcagcatatgagaattcatactggagagaagccctataaatgtaaagaatgtgggaaagcctttgctcatagctcatctcttactgaacatcatagaactcacactggtgagaagctctataaatgtagtgagtgtgagaaaaccttccgcaagtatgcacaccttagtgaacattacagaattcacactggtgagaagccttatgagtgtattgagtgtggaaagttcttcagacatagttcagtccttttcagacatcagaaacttcacagtggtgactaatgctgccatttaggttatgacagtttctctagcgaggatgactacgaatctgactgggagtagaggggcaggtagagttcctggagggaaggatgaaggagccttggctactgtactctgagaggaatgtttccagaaatggaggtgggagcttagggaatgcagagcctacttgaggtgggcatctgggaatacagggtagaaagaaattcctgcttttcagataaagcctacacattgccactgtctccccatgtgactcttacagcttgaggaggcatttgttagcacttctgttcactttactacatcctgccccacattctgacttgtcacccattttcgttggctggcaggttgagatgtttttcttaaacactgcctgtcagtgtgaagtggcacagctctgatgtagtgctaagtctagcctccagatttgaggcagccctgaccatgctaccatgggggaggctcccaacctgtggaagtggtcctgtgaaaaggagacagaaacaagtaagagccaaaaaaaaaaaaaaaaaaaatccatatccattcattaaaaaaatgagatataaagcaacaactgggctgacctctatagatctgccagtaaagaaggctttctttcattatcagggtgaaggtctttcctgattcttccaagctttgaggtgactcagagctaagaatgaaataggagaccaagttagaattcatgatactggtttatggggaggcagtcatacctgttcagagaaccaggaagactcaatatctatctcagaggaaatatggttacccaggaaagaaatggtctgctagagtgataagactcagaacaggaagcctgcatgtgactgagcaagtcacctacataaccctgcctgtactaaggtgtacacctgtctattgtaagtttgcctaggctgttggtgtacagagaccagaggagagagacacactaggactaacaatgtcctaacaaaatggtacttagtttgttggtctttaggagaaagcattagtaatgaaagaagaaagaattttcacttggttggacattggggctgcttaagaaagttgacatttgtcgtggaatgactttggaaagacttctaaaagaatctttttcaaatccctgaaaatcaggatagcacattttgctactgactgtgacagtgttttattcttttgagagaaatgacatagttttccctttatttcccaaattcctttcatgttcttaactgctacccagaaattgagcttcagaagattgaggatagcctttgattggtatttaaaataatttctaagctgtgaagcttatagcatttttaaagtatggctattaaaaacactaagttgattctggaaaaaaaaaaaaaaaa

What is claimed:

1. A method of assaying a sample obtained from a human patient suffering from cancer, the method comprising measuring a nucleic acid expression level of each biomarker in a plurality of biomarkers in the sample obtained from the human patient suffering from cancer using an amplification, hybridization and/or sequencing assay, wherein the plurality of biomarkers consists of only apoptotic chromatin condensation inducer 1 (ACIN1), aminoacylase 1 (ACY1), TLE family member 5, transcriptional modulator (AES), Ankyrin repeat domain-containing protein 50 (ANKRD50), Annexin A10 (ANXA10), adaptor related protein complex 1 subunit gamma 2 (APIG2), apolipoprotein L1 (APOL1), Rho Guanine Nucleotide Exchange Factor 10 Like (ARHGEF10L), BTB domain containing 16 (BTBD16), chromosome 2 open reading frame 66 (C2orf66), carbonyl reductase 4 (CBR4), chloride channel accessory 4 (CLCA4), CDC like kinase 1 (CLK1), cytochrome P450 family 3 subfamily A member 5 (CYP3A5), neuronal vesicle trafficking associated 1 (D4S234E), diacylglycerol kinase alpha (DGKA), diacylglycerol kinase theta (DGKQ), dehydrogenase/reductase 3 (DHRS3), EPH receptor B6 (EPHB6), fatty acid binding protein 6 (FABP6), family with sequence similarity 155 member B (FAM155B), fibroblast growth factor receptor 3 (FGFR3), GIPC PDZ domain containing family member 1 (GIPC1), gastric inhibitory polypeptide receptor (GIPR), G protein-coupled receptor 108 (GPR108), histone deacetylase 10 (HDAC10), homeobox B3 (HOXB3), homeobox B4 (HOXB4), homeobox B6 (HOXB6), homeobox D4 (HOXD4), JMJD7-PLA2G4B readthrough (JMJD7-PLA2G4B), keratin associated protein 5-10 (KRTAP5-10), LIM domain binding 1 (LDB1), lipoprotein (a) (LPA), lysophosphatidylcholine acyltransferase 4 (LPCAT4), LUC7 like (LUC7L), mannosidase alpha class 2C member 1 (MAN2C1), methyl-CpG binding domain protein 6 (MBD6), microsomal glutathione S-transferase 2 (MGST2), MAPK interacting serine/threonine kinase 2 (MKNK2), membrane metalloendopeptidase like 1 (MMEL1), NAD synthetase 1 (NADSYN1), NDUFA4 mitochondrial complex associated like 2 (NDUFA4L2), nuclear RNA export factor 3 (NXF3), olfactory receptor family 9 subfamily K member 2 (OR9K2), protein interacting with PRKCA 1 (PICK1), phosphoinositide-3-kinase regulatory subunit 2 (PIK3R2), phospholipase C delta 3 (PLCD3), pleckstrin homology domain containing, family H (with MyTH4 domain) member 3 (PLEKHH3), plexin B3 (PLXNB3), pre-mRNA processing factor 40 homolog B (PRPF40B), retinoic acid induced 1 (RAI1), ras homolog family member T2 (RHOT2), semaphorin 4B (SEMA4B), SH3 domain binding protein 1 (SH3BP1), SMAD family member 3 (SMAD3), sorting nexin 1 (SNX1), SRY-box transcription factor 15 (SOX15), spermatogenesis associated 20 (SPATA20), SAM pointed domain containing ETS transcription factor (SPDEF), SPOC domain containing 1 (SPOCD1), slingshot protein phosphatase 3 (SSH3), synaptotagmin like 1 (SYTL1), transcriptional adaptor 2B (TADA2B), trefoil factor 1 (TFF1), transmembrane BAX inhibitor motif containing 4 (TMBIM4), transmembrane serine protease 4 (TMPRSS4), toll interacting protein (TOLLIP), TraB domain containing (TRABD), TRIO and F-actin binding protein (TRIOBP), tetraspanin 14 (TSPAN14), translocator protein (TSPO), tubulin gamma 2 (TUBG2), tubulin gamma complex associated protein 6 (TUBGCP6), thioredoxin domain containing 17 (TXNDC17), UDP glucuronosyltransferase family 2 member B28 (UGT2B28), Wnt family member 7B (WNT7B), zinc finger and BTB domain containing 7A (ZBTB7A), zinc finger protein 385A (ZNF385A) and zinc finger protein 692 (ZNF692).

2. The method of claim 1, wherein the sample is a formalin-fixed, paraffin-embedded (FFPE) lung tissue sample, fresh or a frozen tissue sample, an exosome, wash fluids, cell pellets, or a bodily fluid obtained from the patient.

* * * * *